United States Patent
Perot et al.

(10) Patent No.: US 11,453,920 B2
(45) Date of Patent: Sep. 27, 2022

(54) METHOD FOR THE IN VITRO DIAGNOSIS OR PROGNOSIS OF OVARIAN CANCER

(71) Applicant: BIOMERIEUX, Marcy-l'Etoile (FR)

(72) Inventors: Philippe Perot, Lyons (FR); François Mallet, Villeurbanne (FR); Nathalie Mugnier, Lyons (FR)

(73) Assignee: BIOMERIEUX, Marcy l'Etoile (FR)

( * ) Notice: Subject to any disclaimer, the term of this patent is extended or adjusted under 35 U.S.C. 154(b) by 80 days.

(21) Appl. No.: 14/367,608

(22) PCT Filed: Dec. 19, 2012

(86) PCT No.: PCT/FR2012/053003
§ 371 (c)(1),
(2) Date: Jun. 20, 2014

(87) PCT Pub. No.: WO2013/093347
PCT Pub. Date: Jun. 27, 2013

(65) Prior Publication Data
US 2015/0065368 A1 Mar. 5, 2015

(30) Foreign Application Priority Data
Dec. 20, 2011 (FR) .................................. 11/62104

(51) Int. Cl.
*C12Q 1/70* (2006.01)
*C12Q 1/6886* (2018.01)
*G01N 33/574* (2006.01)

(52) U.S. Cl.
CPC .......... *C12Q 1/702* (2013.01); *C12Q 1/6886* (2013.01); *G01N 33/57449* (2013.01); *C12Q 2600/106* (2013.01); *C12Q 2600/118* (2013.01); *C12Q 2600/158* (2013.01); *C12Q 2600/178* (2013.01); *G01N 2800/52* (2013.01)

(58) Field of Classification Search
CPC combination set(s) only.
See application file for complete search history.

(56) References Cited

U.S. PATENT DOCUMENTS

| | | | | |
|---|---|---|---|---|
| 2001/0053519 | A1* | 12/2001 | Fodor | B01J 19/0046 435/6.11 |
| 2006/0115806 | A1* | 6/2006 | McDonald | C12Q 1/6886 435/5 |
| 2009/0214542 | A1* | 8/2009 | Morris | C07K 14/4748 424/138.1 |
| 2009/0297530 | A1* | 12/2009 | Wang-Johanning | G01N 33/57434 424/139.1 |
| 2010/0086537 | A1* | 4/2010 | Sooknanan | A61K 31/7088 424/130.1 |
| 2015/0065369 | A1* | 3/2015 | Perot | C12Q 1/6886 506/9 |

FOREIGN PATENT DOCUMENTS

| | | | | |
|---|---|---|---|---|
| EP | 2 340 851 | A1 | 7/2011 | |
| FR | WO 9823755 | A1 * | 6/1998 | ........... C07K 14/005 |
| WO | WO 01/70979 | A2 | 9/2001 | |
| WO | WO 0246477 | A2 * | 6/2002 | ........... C07K 14/005 |
| WO | WO 02/079473 | A2 | 10/2002 | |
| WO | WO 2007/137279 | A2 | 11/2007 | |

OTHER PUBLICATIONS

Stauffer (Cancer Immunity (2004) vol. 4, p. 2).*
Perot et al (PLOS One (2012) vol. 7, pp. e40194).*
Benner et al (Trends in Genetics (2001) vol. 17, pp. 414-418).*
Greenbaum et al (Genome Biology 2003, vol. 4, article 117, pp. 1-8).*
Cheung et al (Nature Genetics, 2003, vol. 33, pp. 422-425).*
Saito-Hisaminato et al (DNA research (2002) vol. 9, pp. 35-45).*
Wu (Journal of Pathology, 2001, vol. 195, pp. 53-65).*
Munroe et al (Molecular and Cellular Biology (1990) vol. 10, pp. 3441-3455).*
Ncbi blast ( http://blast.ncbi.nlm.nih.gov/Blast.cgi, May 25, 2016.*
Shah ( The New England Journal of medicine (2009) vol. 360, pp. 2719-2729).*
GenBank AC092765 AL358778 (https://www.ncbi.nlm.nih.gov/nuccore/ac092765.2, May 30, 2002).*
GenBank Accession AC091867 (https://www.ncbi.nlm.nih.gov/nuccore/ac091867.3, Feb. 26, 2002).*
Lower ( Proceedings National Academy of Science (1996) vol. 93, pp. 5177-5184).*
Gimenez (Nucleic Acids Research (2010)vol. 38, pp. 2229-2246).*
Menendez (Molecular cancer (2004, vol. 3:12) pp. 1-5).*
Wada (Genes & Development (1998) vol. 12, pp. 343-356.*
BLAST® » blastn suite-2sequences » RID-K9RTADYU11N(https://blast.ncbi.nlm.nih.gov/Blast.cgi, downloaded Jun. 28, 2018).*
GenBank Accession AC113137.2 (https://www.ncbi.nlm.nih.gov/nucleotide/AC113137.2, Apr. 25, 2002).*
GenBank Accession 133480.2 (https://www.ncbi.nlm.nih.gov/nucleotide/AC133480.2?report=genbank&log$=nuclalign&blast_rank=8&RID=VDS34NKZ015, Sep. 28, 2002).*
Kim (Arch Virol (2008) vol. 153, pp. 1587-1591).*
Kimura (Genome Research (2005) vol. 16, p. 55-65).*
Herbst (APMIS(1998) vol. 106, pp. 216-220).*
Herbst (Virchows Arch (199) vol. 434, pp. 11-15).*
Larsson (Upsala Journal of Medical Sciences (1994) vol. 99, pp. 113-120).*

(Continued)

*Primary Examiner* — Steven Pohnert
(74) *Attorney, Agent, or Firm* — Oliff PLC (57) ABSTRACT

The present invention relates to a method for the in vitro diagnosis or prognosis of ovarian cancer, which includes a step of detecting at least one expression product of at least one HERV nucleic acid sequence, the use of said nucleic acid sequences, once isolated, as one or more molecular marker(s) and a kit including at least one specific binding partner of at least one of the expression products of the HERV nucleic acid sequences.

19 Claims, 2 Drawing Sheets
Specification includes a Sequence Listing.

(56) References Cited

OTHER PUBLICATIONS

Hu (AIDS research and Human retroviruses I2006) vol. 22, pp. 551-557).*

Menendez(Molecular Cancer (2004) vol. 3, pp. 1-5).*

Wang-Johannig ( Int J Cancer (2006) vol. 120, pp. 81-90).*

Pace (nucleic Acid research (2004) vol. 32, D50).*

Nickerson et al., "DNA Sequence Diversity in a 9.7-kb Region of the Human Lipoprotein Lipase Gene," *Nature Genetics*, Jul. 1998, vol. 19, pp. 233-240.

Navarro et al., "Flexible Pattern Matching in Strings: Practical On-Line Search Algorithms for Texts and Biological Sequences," (2002), Cambridge University Press.

Irizarry et al., "Exploration, Normalization, and Summaries of High Density Oligonucleotide Array Probe Level Data," *Biostatistics*, 2003, vol. 4, No. 2, pp. 249-264.

Johnson et al., "Adjusting Batch Effects in Microarray Expression Data Using Empirical Bayes Methods," *Biostatistics*, 2007, vol. 8, No. 1, pp. 118-127.

Tusher et al., "Significance Analysis of Microarrays Applied to the Ionizing Radiation Response," *PNAS*, Apr. 24, 2001, vol. 98, No. 9, pp. 5116-5121.

Storey et al., "Statistical Significance for Genomewide Studies," *PNAS*, Aug. 5, 2003, vol. 100, No. 16, pp. 9440-9445.

Wang-Johanning et al., "Expression of Multiple Human Endogenous Retrovirus Surface Envelope Proteins in Ovarian Cancer," *Int. J. Cancer*, 2006, vol. 120, pp. 81-90.

Gimenez et al., "Custom Human Endogenous Retroviruses Dedicated Microarray Identifies Self-Induced HERV-W Family Elements Reactivated in Testicular Cancer Upon Methylation Control," *Nucleic Acids Research*, 2010, vol. 38, No. 7, pp. 2229-2246.

Seifarth et al., "Comprehensive Analysis of Human Endogenous Retrovirus Transcriptional Activity in Human Tissues with a Retrovirus-Specific Microarray," *Journal of Virology*, Jan. 2005, vol. 79, No. 1, pp. 341-352.

Pačes et al., "HERVd: the Human Endogenous RetroViruses Database: Update," *Nucleic Acids Research*, 2004, vol. 32.

"*Homo sapiens* BAC Clone RP11-432D12 from 2, Complete Sequence," XP002694976. retrieved from EBI Accession No. EM_STD:AC007319, Database Accession No. AC007319.

"Human DNA Sequence from Clone RP4-603114 on Chromosome 1p31.3-33," XP002694977. retrieved from EBI Accession No. EM_STD:AL122001, Database Accession No. AL122001.

"*Homo sapiens* FOSMID Clone ABS9-44034100M10 from Chromosome 1, Complete Sequence," XP002694978. retrieved from EBI Accession No. EM_STD:AC207061, Database Accession No. AC207061.

Menendez et al., "LI and HERV-W Retrotransponsons are Hypomethylated in Human Ovarian Carcinomas," *Molecular Cancer, BioMed Central*, 2004, vol. 3, pp. 1-5.

Pérot et al., Microarray-Based Sketches of the HERV Transcriptome Landscape, *PLOS One*, Jun. 2012, vol. 7, Issue 6, pp. 1-6.

"*Homo sapiens* Chromosome 5 Clone CTD-2365E22, Complete Sequence," XP002698070. retrieved from EBI Accession No. EM_STD:AC091867, Database Accession No. AC091867.

"*Homo sapiens* Chromosome 1 Clone RP11-400N13, Complete Sequence," XP002698071. retrieved from EBI Accession No. EM_STD:AC092765, Database Accession No. AC092765.

"*Homo sapiens* BAC Clone RP13-644M16 from 3, Complete Sequence," XP002698072. retrieved from EBI Accession No. EM_STD:AC111000, Database Accession No. AC111000.

International Search Report issued in International Patent Application No. PCT/FR2012/053003 dated Jul. 1, 2013.

Written Opinion issued in International Patent Application No. PCT/FR2012/053003 dated Jul. 1, 2013.

* cited by examiner

METHOD FOR THE IN VITRO DIAGNOSIS OR PROGNOSIS OF OVARIAN CANCER

Endogenous retroviruses constitute the progeny of infectious retroviruses which have integrated, in their proviral form, into germ line cells and which have been transmitted via this means into the genome of the progeny of the host.

The sequencing of the human genome has made it possible to reveal the extremely high abundance of transposable elements or derivatives thereof. In fact, repeated sequences represent close to half the human genome and endogenous retroviruses and retrotransposons make up 8% of said genome, with the number of elements, at the current time, coming to more than 400,000.

The abundance of endogenous retroviral elements (ERVs) currently present in the human genome is the result of about 100 endogenizations which have successfully taken place during the course of the evolution of the human line. The various waves of endogenization are spread out over a period ranging from 2 to 90 million years before our era and have been followed by the expansion of the number of copies via phenomena of the "copy/paste" type with the possibility of the appearance of errors, resulting, starting from an ancestral provirus, in the formation of a family of HERVS, i.e. a set of elements which exhibit sequence homologies. The oldest elements, those of the HERV-L family, supposedly became integrated before the emergence of mammals. Two families, HERV-F and HERV-H, appeared during the period when the first primates were making their appearance. The HERV-FRD and HERV-K(HML-5) families, integrated 40 to 55 million years ago, are specific for higher primates. On the other hand, the HERV-W and HERV-E families, for example, became integrated 5 to 10 million years later, after the separation with New World monkeys, and are specific for the Catarrhini (Hominoids and Cercopithecidae).

The ERV sequences are represented on all the chromosomes, with a varying density according to the families, and there is no correlation between the physical proximity of ERVs and their phylogenetic proximity.

For a long time, ERVs have been considered to be parasites or to be simple DNA waste. Nevertheless, the impact of ERVs on the organism is not only limited to their past participation in modelling the genome or to delete rious recombinations which may still provide support.

The abundance and the structural complexity of ERVs makes analyses of their expression very complicated and often difficult to interpret. The detection of HERV expression may reflect the transcriptional activation of one or more loci within the same family. The activated locus or loci may in addition vary according to the tissue and/or the context.

The present inventors have now discovered and demonstrated that nucleic acid sequences corresponding to precisely identified loci of endogenous retroviral elements are associated with ovarian cancer and that these sequences are molecular markers of the pathological condition. The sequences identified are either proviruses, i.e. sequences containing all or part of the gag, pol and env genes flanked in the 5' and 3' positions by long terminal repeats (LTRs), or all or part of the LTRs or of the genes isolated. The DNA sequences identified are respectively referenced as SEQ ID NO: 1 to 510 in the sequence listing, their chromosomal location is identified in the table below (NCBI 36/hg18), as are their expression, overexpression or underexpression represented by the "expression ratio" between cancer sample and normal sample. When the expression of the nucleic acid or the change in the expression of the nucleic acid is specific for ovarian tissue, this information is indicated by the symbol "x" in the target tissue column. This signifies that, if an expression or a change in expression of the nucleic acid concerned is determined in a biological compartment other than ovarian tissue, this represents, remotely, a signature of ovarian cancer. The DNA sequences identified as being specific for ovarian tissue are respectively referenced as SEQ ID NOs: SEQ ID NO: 2, 3, 6, 9, 10, 11, 20, 23, 24, 25, 26, 30, 34, 59 and 139. The DNA sequences identified as being not specific for ovarian tissue are respectively referenced as SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510.

TABLE

| SEQ ID NO: | Chromosomal location | Target tissue | Cancer/normal expression ratio |
|---|---|---|---|
| 1 | (−) chr 1: 204451670- | | 23.6 |
| 2 | (−) chr 5: 31145123-31145616 | x | 20.6 |
| 3 | (−) chr 1: 220215255- | x | 18.9 |
| 4 | (+) chr 20: 15876573-15877028 | | 15.3 |
| 5 | (−) chr 10: 85918238-85921075 | | 13.9 |
| 6 | (+) chr 4: 69952306-69955060 | x | 10.7 |
| 7 | (−) chr 7: 136602660- | | 9.4 |
| 8 | (−) chr 19: 21408391-21408433 | | −9.3 |
| 9 | (+) chr 5: 138886787- | x | 8.7 |
| 10 | (+) chr 1: 53662597-53668291 | x | 8.2 |
| 11 | (−) chr 11: 61892539-61895047 | x | 6.8 |
| 12 | (−) chr 6: 31258778-31261514 | | 6.8 |
| 13 | (−) chr 4: 92495874-92498563 | | 6.2 |

TABLE-continued

| SEQ ID NO: | Chromosomal location | Target tissue | Cancer/normal expression ratio |
|---|---|---|---|
| 14 | (−) chr 17: 72119645-72120398 | | 6.2 |
| 15 | (+) chr 13: 108715439- | | 5.8 |
| 16 | (−) chr 4: 92408723-92409131 | | 5.3 |
| 17 | (+) chr 2: 188084458- | | −5.1 |
| 18 | (+) chr 1: 201726731- | | −5.1 |
| 19 | (−) chr 20: 15911118-15913833 | | 4.8 |
| 20 | (−) chr 2: 34879568-34885219 | x | 4.5 |
| 21 | (−) chr 3: 32480101-32483411 | | 4.3 |
| 22 | (−) chr 1: 20229120-20230095 | | −4.0 |
| 23 | (−) chr 3: 32477433-32480101 | x | 3.9 |
| 24 | (−) chr X: 135840667- | x | 3.7 |
| 25 | (−) chr 6: 27901601-27902447 | x | 3.7 |
| 26 | (−) chr 7: 120206619- | x | 3.7 |
| 27 | (−) chr 2: 54587807-54590183 | | −3.6 |
| 28 | (+) chr 11: 302654-302777 | | −3.6 |
| 29 | (−) chr 1: 46569499-46569788 | | 3.5 |
| 30 | (+) chr 13: 79655647-79662117 | x | 3.5 |
| 31 | (+) chr 2: 223763483- | | −3.2 |
| 32 | (−) chr 21: 16686151-16692725 | | −3.2 |
| 33 | (+) chr 7: 22344951-22345519 | | 3.2 |
| 34 | (−) chr 1: 77133084-77138660 | x | 2.9 |
| 35 | (−) chr 3: 5525407-5525762 | | 2.9 |
| 36 | (+) chr 19: 5797895-5801213 | | 2.8 |
| 37 | (+) chr 5: 162693944- | | 2.8 |
| 38 | (+) chr 22: 22208249-22219093 | | 2.7 |
| 39 | (+) chr 11: 123241237- | | 2.7 |
| 40 | (+) chr X: 18907929-18908893 | | 2.6 |
| 41 | (+) chr 8: 116896352- | | 2.6 |
| 42 | (+) chr 1: 46568022-46568774 | | 2.5 |
| 43 | (−) chr 3: 44361156-44367804 | | 2.5 |
| 44 | (−) chr 12: 123151029- | | 2.5 |
| 45 | (−) chr 3: 171872658- | | −2.5 |
| 46 | (−) chr 18: 24526989-24532843 | | 2.4 |
| 47 | (−) chr 4: 190639686- | | 2.4 |
| 48 | (−) chr 3: 172018098- | | −2.4 |
| 49 | (+) chr 5: 109894536- | | 2.4 |
| 50 | (+) chr 9: 139130635- | | 2.4 |
| 51 | (−) chr 17: 59750387-59751101 | | −2.4 |
| 52 | (+) chr 2: 63928103-63928550 | | −2.3 |
| 53 | (−) chr 1: 23201713-23201784 | | −2.3 |
| 54 | (−) chr X: 119100721- | | 2.3 |
| 55 | (+) chr 1: 38146074-38152175 | | −2.3 |
| 56 | (−) chr 6: 131686129- | | −2.3 |
| 57 | (+) chr 2: 34868390-34874629 | | 2.2 |
| 58 | (−) chr X: 119100721- | | 2.2 |
| 59 | (+) chr 2: 188606470- | x | 2.2 |
| 60 | (+) chr 3: 149764167- | | −2.2 |
| 61 | (−) chr X: 16107244-16112478 | | 2.1 |
| 62 | (+) chr 16: 20680398-20681069 | | −2.1 |
| 63 | (−) chr 17: 16678919-16679896 | | −2.1 |
| 64 | (+) chr 4: 53395726-53396112 | | 2.1 |
| 65 | (−) chr 19: 58630272-58630359 | | 2.1 |
| 66 | (+) chr 14: 22268133-22268207 | | −2.0 |
| 67 | (+) chr 16: 29617077-29617563 | | 2.0 |
| 68 | (+) chr 7: 93107183-93112802 | | 2.0 |
| 69 | (+) chr 1: 226879232- | | −2.0 |
| 70 | (+) chr 7: 97418554-97422641 | | 2.0 |
| 71 | (+) chr 2: 175898117- | | −2.0 |
| 72 | (−) chr X: 153489882- | | −2.0 |
| 73 | (+) chr 12: 10006301-10012556 | | 2.0 |
| 74 | (+) chr 17: 49777998-49778501 | | 2.0 |
| 75 | (−) chr 10: 62463482-62469677 | | 2.0 |
| 76 | (+) chr 7: 63784637-63784717 | | 1.9 |
| 77 | (−) chr 9: 22648524-22654061 | | −1.9 |
| 78 | (−) chr 19: 41338217-41343765 | | 1.9 |
| 79 | (+) chr 3: 75269085-75276706 | | −1.9 |
| 80 | (+) chr 14: 50429630-50433350 | | 1.9 |
| 81 | (+) chr 3: 113681517- | | 1.9 |
| 82 | (+) chr 17: 18280923-18281897 | | −1.9 |
| 83 | (+) chr 17: 30852752-30853047 | | −1.9 |
| 84 | (−) chr 7: 16683220-16684043 | | 1.9 |
| 85 | (+) chr 17: 72113663-72119188 | | 1.9 |
| 86 | (−) chr 6: 66439380-66440579 | | 1.9 |
| 87 | (+) chr 14: 49582825-49583215 | | 1.9 |
| 88 | (−) chr 3: 146311752- | | 1.9 |
| 89 | (−) chr 6: 82110364-82117596 | | −1.9 |
| 90 | (−) chr 16: 8834700-8846815 | | 1.8 |
| 91 | (−) chr 3: 83646334-83646729 | | −1.8 |
| 92 | (+) chr 2: 57102769-57103266 | | 1.8 |
| 93 | (−) chr 9: 87683968-87685669 | | 1.8 |
| 94 | (+) chr 17: 7905950-7906340 | | 1.8 |
| 95 | (−) chr 1: 79726879-79732396 | | 1.8 |
| 96 | (+) chr X: 154839291- | | 1.8 |
| 97 | (−) chr 1: 20240363-20244851 | | −1.8 |
| 98 | (−) chr 19: 51297295-51305072 | | 1.8 |
| 99 | (−) chr 1: 89419377-89419778 | | −1.8 |
| 100 | (+) chr 13: 61603944-61604298 | | 1.8 |
| 101 | (−) chr 5: 81601427-81604174 | | 1.8 |
| 102 | (−) chr 11: 61899593-61907139 | | 1.8 |
| 103 | (+) chr 1: 237429952- | | −1.8 |
| 104 | (+) chr 19: 23052386-23053407 | | 1.8 |
| 105 | (+) chr 4: 149285541- | | −1.8 |
| 106 | (+) chr 13: 78118938-78119911 | | 1.8 |
| 107 | (+) chr 1: 46558555-46559522 | | 1.8 |
| 108 | (−) chr X: 107838-108808 | | 1.8 |
| 109 | (−) chr 6: 5981329-5981780 | | 1.8 |
| 110 | (+) chr 5: 79443327-79444232 | | 1.7 |
| 111 | (+) chr 3: 102893427- | | 1.7 |
| 112 | (+) chr 17: 70760297-70765658 | | 1.7 |
| 113 | (−) chr 3: 130842785- | | 1.7 |
| 114 | (−) chr 14: 45033906-45038685 | | 1.7 |
| 115 | (+) chr 7: 63778493-63778556 | | 1.7 |
| 116 | (+) chr 5: 130936343- | | 1.7 |
| 117 | (+) chr 15: 88477019-88482534 | | −1.7 |
| 118 | (+) chr 2: 30592323-30596634 | | −1.7 |
| 119 | (+) chr 3: 100621292- | | −1.7 |
| 120 | (+) chr 3: 28017061-28017725 | | −1.7 |
| 121 | (+) chr 4: 121134267- | | 1.7 |
| 122 | (−) chr 1: 113164281- | | 1.7 |
| 123 | (+) chr 2: 231645891- | | 1.7 |
| 124 | (−) chr 20: 23684500-23685884 | | −1.7 |
| 125 | (+) chr 21: 41248565-41252290 | | 1.7 |
| 126 | (−) chr 7: 26030345-26035880 | | 1.7 |
| 127 | (−) chr 1: 82866215-82866932 | | 1.7 |
| 128 | (−) chr 19: 36769982-36771248 | | 1.7 |
| 129 | (−) chr 8: 99671725-99672015 | | 1.7 |
| 130 | (−) chr 21: 45534498-45534683 | | −1.7 |
| 131 | (+) chr 8: 72739454-72745239 | | 1.7 |
| 132 | (+) chr 1: 171710187- | | 1.7 |
| 133 | (−) chr 4: 80695843-80699887 | | −1.7 |
| 134 | (−) chr 20: 15076339-15082148 | | 1.7 |
| 135 | (−) chr 18: 26600808-26601241 | | −1.6 |
| 136 | (−) chr 19: 48519503-48525376 | | 1.6 |
| 137 | (+) chr 4: 184621848- | | −1.6 |
| 138 | (−) chr 5: 118311697- | | 1.6 |
| 139 | (+) chr 20: 825581-830240 | x | 1.6 |
| 140 | (−) chr X: 73258716-73266192 | | −1.6 |
| 141 | (−) chr 6: 137423130- | | −1.6 |
| 142 | (−) chr 19: 43813619-43814569 | | 1.6 |
| 143 | (−) chr 6: 166679549- | | 1.6 |
| 144 | (−) chr 3: 170131404- | | −1.6 |
| 145 | (−) chr 9: 73768007-73768097 | | −1.6 |
| 146 | (−) chr 19: 42435136-42435718 | | 1.6 |
| 147 | (+) chr 3: 127091992- | | −1.6 |
| 148 | (−) chr 3: 70566511-70572260 | | 1.6 |
| 149 | (+) chr 7: 134507781- | | 1.6 |
| 150 | (+) chr 1: 101404629- | | −1.6 |
| 151 | (+) chr 19: 63026807-63027775 | | 1.6 |
| 152 | (+) chr 20: 740491-741481 | | 1.6 |
| 153 | (+) chr 10: 100097920- | | −1.6 |
| 154 | (+) chr 4: 87614948-87620699 | | 1.6 |
| 155 | (−) chr 3: 188666779- | | 1.6 |
| 156 | (+) chr 12: 8805277-8812326 | | −1.6 |
| 157 | (−) chr 1: 119033717- | | 1.6 |
| 158 | (+) chr 2: 194703669- | | 1.6 |
| 159 | (−) chr 7: 53274415-53274795 | | 1.6 |
| 160 | (+) chr 19: 60146916-60147844 | | 1.6 |
| 161 | (+) chr 9: 21911892-21921934 | | 1.6 |
| 162 | (+) chr 17: 18280923-18281897 | | −1.6 |
| 163 | (+) chr X: 3737016-3737408 | | −1.6 |
| 164 | (−) chr 3: 186765708- | | 1.6 |
| 165 | (−) chr X: 64265907-64271621 | | 1.6 |
| 166 | (−) chr 21: 43094024-43099757 | | 1.6 |
| 167 | (−) chr Y: 4283432-4289271 | | 1.6 |

TABLE-continued

| SEQ ID NO: | Chromosomal location | Target tissue | Cancer/normal expression ratio |
|---|---|---|---|
| 168 | (+) chr 1: 227127533- | | 1.6 |
| 169 | (+) chr 19: 58638840-58639824 | | 1.6 |
| 170 | (+) chr 1: 55260969-55266632 | | 1.6 |
| 171 | (−) chr 6: 161967666- | | 1.5 |
| 172 | (−) chr 18: 8170226-8170996 | | −1.5 |
| 173 | (−) chr 17: 64303192-64305325 | | −1.5 |
| 174 | (−) chr 4: 139016243- | | 1.5 |
| 175 | (−) chr 9: 90136987-90137726 | | 1.5 |
| 176 | (+) chr 16: 84869202-84872386 | | 1.5 |
| 177 | (+) chr 18: 69142830-69148577 | | 1.5 |
| 178 | (−) chr 14: 38837505-38837576 | | 1.5 |
| 179 | (−) chr 5: 164658658- | | 1.5 |
| 180 | (+) chr 4: 16529457-16529865 | | 1.5 |
| 181 | (+) chr 14: 58981836-58986258 | | 1.5 |
| 182 | (+) chr 11: 20545997-20550777 | | 1.5 |
| 183 | (+) chr 7: 24405964-24408131 | | 1.5 |
| 184 | (+) chr 8: 98282174-98288062 | | −1.5 |
| 185 | (−) chr 15: 51506333-51511952 | | 1.5 |
| 186 | (+) chr 17: 57579448-57580087 | | 1.5 |
| 187 | (+) chr 2: 173115073- | | 1.5 |
| 188 | (−) chr 14: 100841342- | | −1.5 |
| 189 | (−) chr 1: 223094264- | | 1.5 |
| 190 | (+) chr 19: 42188901-42189862 | | 1.5 |
| 191 | (−) chr 1: 110071319- | | 1.5 |
| 192 | (+) chr 11: 71138116-71141391 | | −1.5 |
| 193 | (+) chr 17: 11815798-11820989 | | 1.5 |
| 194 | (−) chr 21: 26522067-26527677 | | 1.5 |
| 195 | (−) chr 13: 110287593- | | −1.5 |
| 196 | (−) chr 12: 14769094-14769447 | | −1.5 |
| 197 | (−) chr 8: 828875-829287 | | 1.5 |
| 198 | (+) chr 2: 57307944-57315854 | | −1.5 |
| 199 | (+) chr 15: 72433538-72439180 | | −1.5 |
| 200 | (−) chr 20: 30839204-30839675 | | 1.5 |
| 201 | (+) chr 6: 121287670- | | 1.5 |
| 202 | (−) chr 5: 92818136-92819135 | | −1.5 |
| 203 | (−) chr 2: 80956433-80960797 | | 1.5 |
| 204 | (−) chr 3: 133114616- | | 1.5 |
| 205 | (+) chr 15: 93094982-93104611 | | 1.5 |
| 206 | (−) chr 17: 41716757-41717724 | | 1.5 |
| 207 | (+) chr 1: 208103713- | | 1.5 |
| 208 | (+) chr 7: 20126857-20130993 | | 1.5 |
| 209 | (−) chr 5: 152811649- | | −1.5 |
| 210 | (+) chr 21: 19397535-19398503 | | 1.5 |
| 211 | (−) chr 1: 205981124- | | 1.5 |
| 212 | (−) chr 13: 63016887-63017674 | | −1.5 |
| 213 | (−) chr 2: 40978866-40978933 | | 1.5 |
| 214 | (−) chr 6: 123945178- | | 1.5 |
| 215 | (−) chr 12: 20983776-20984452 | | 1.5 |
| 216 | (−) chr 4: 41854992-41855740 | | 1.5 |
| 217 | (+) chr 19: 57816195-57826383 | | 1.5 |
| 218 | (+) chr 3: 198173309- | | 1.5 |
| 219 | (−) chr 4: 5101984-5102366 | | 1.5 |
| 220 | (−) chr 11: 42988611-42989260 | | 1.5 |
| 221 | (−) chr 10: 53463521-53469327 | | −1.5 |
| 222 | (+) chr 2: 215375861- | | 1.5 |
| 223 | (−) chr 1: 39742864-39743840 | | −1.5 |
| 224 | (+) chr 2: 49358270-49358629 | | −1.5 |
| 225 | (+) chr 3: 37222224-37226355 | | 1.5 |
| 226 | (−) chr 6: 11215545-11220435 | | 1.5 |
| 227 | (+) chr 4: 177452380- | | 1.4 |
| 228 | (−) chr 3: 193273756- | | 1.4 |
| 229 | (+) chr 13: 35788462-35794330 | | −1.4 |
| 230 | (+) chr 8: 90837193-90837630 | | 1.4 |
| 231 | (−) chr 6: 126064685- | | 1.4 |
| 232 | (−) chr 9: 92557313-92561369 | | 1.4 |
| 233 | (+) chr 13: 34271392-34275485 | | 1.4 |
| 234 | (−) chr 2: 188741658- | | −1.4 |
| 235 | (−) chr 6: 131658190- | | 1.4 |
| 236 | (−) chr 4: 11264289-11269976 | | 1.4 |
| 237 | (−) chr 3: 167701085- | | 1.4 |
| 238 | (−) chr 8: 34837245-34837699 | | 1.4 |
| 239 | (−) chr X: 84258326-84258441 | | 1.4 |
| 240 | (−) chr 1: 230032039- | | −1.4 |
| 241 | (−) chr 1: 1340045-1340674 | | 1.4 |
| 242 | (−) chr 11: 23865384-23871043 | | 1.4 |
| 243 | (+) chr 15: 53797305-53798112 | | 1.4 |
| 244 | (+) chr 8: 105367316- | | 1.4 |
| 245 | (+) chr 6: 36585121-36585596 | | 1.4 |
| 246 | (−) chr 3: 180722967- | | −1.4 |
| 247 | (+) chr 1: 113153812- | | −1.4 |
| 248 | (+) chr 6: 123203066- | | −1.4 |
| 249 | (+) chr 13: 40927858-40928571 | | 1.4 |
| 250 | (+) chr 2: 151518177- | | −1.4 |
| 251 | (+) chr 4: 125955713- | | 1.4 |
| 252 | (−) chr 10: 6879049-6884921 | | −1.4 |
| 253 | (−) chr 2: 38161446-38167158 | | 1.4 |
| 254 | (+) chr 5: 115014416- | | 1.4 |
| 255 | (−) chr 6: 96115220-96116183 | | 1.4 |
| 256 | (+) chr 4: 105081874- | | 1.4 |
| 257 | (−) chr 4: 77184473-77184590 | | 1.4 |
| 258 | (+) chr 1: 237331217- | | 1.4 |
| 259 | (+) chr 5: 129737615- | | 1.4 |
| 260 | (+) chr 10: 72056196-72056562 | | 1.4 |
| 261 | (+) chr 11: 70894199-70894610 | | 1.4 |
| 262 | (−) chr 22: 37782215-37788928 | | −1.4 |
| 263 | (−) chr 19: 60153464-60154429 | | 1.4 |
| 264 | (−) chr 20: 25478990-25479969 | | −1.4 |
| 265 | (+) chr 12: 101073296- | | 1.4 |
| 266 | (+) chr X: 119059748- | | −1.4 |
| 267 | (+) chr 6: 66335631-66336029 | | −1.4 |
| 268 | (−) chr X: 48298854-48299852 | | 1.4 |
| 269 | (−) chr 6: 111714710- | | 1.4 |
| 270 | (+) chr 15: 79410960-79411606 | | −1.4 |
| 271 | (−) chr 4: 20240490-20246699 | | 1.4 |
| 272 | (−) chr 8: 7800551-7804236 | | −1.4 |
| 273 | (−) chr 12: 84386849-84387812 | | 1.4 |
| 274 | (+) chr 1: 237334832- | | −1.4 |
| 275 | (−) chr 13: 22285789-22286759 | | 1.4 |
| 276 | (+) chr 8: 8677169-8677775 | | 1.4 |
| 277 | (−) chr 3: 134664420- | | 1.4 |
| 278 | (+) chr 2: 88760597-88762729 | | −1.4 |
| 279 | (+) chr 18: 71806397-71806963 | | 1.4 |
| 280 | (+) chr 6: 123199111- | | 1.4 |
| 281 | (+) chr 6: 63559535-63565316 | | 1.4 |
| 282 | (−) chr X: 8364892-8365592 | | 1.4 |
| 283 | (−) chr 11: 69581214-69582655 | | 1.4 |
| 284 | (−) chr 16: 57560802-57562053 | | 1.4 |
| 285 | (−) chr 1: 15334421-15335379 | | 1.4 |
| 286 | (+) chr 3: 8130557-8130971 | | −1.4 |
| 287 | (−) chr 6: 80623291-80623866 | | 1.4 |
| 288 | (+) chr 14: 42343224-42346079 | | 1.4 |
| 289 | (−) chr 16: 21140609-21141570 | | 1.4 |
| 290 | (−) chr 7: 146321019- | | −1.4 |
| 291 | (−) chr 11: 92482373-92482685 | | 1.4 |
| 292 | (+) chr 19: 20126744-20133095 | | 1.4 |
| 293 | (+) chr 4: 44685507-44693742 | | 1.4 |
| 294 | (−) chr 13: 54525767-54533878 | | −1.4 |
| 295 | (−) chr 2: 77980822-77981234 | | −1.4 |
| 296 | (−) chr 19: 59483969-59484458 | | 1.4 |
| 297 | (+) chr 18: 13646676-13647837 | | 1.4 |
| 298 | (+) chr 3: 187581597- | | 1.4 |
| 299 | (−) chr 18: 65578866-66580015 | | 1.4 |
| 300 | (+) chr 13: 81344919-81345826 | | −1.4 |
| 301 | (+) chr 9: 12938344-12944129 | | −1.4 |
| 302 | (+) chr X: 119059748- | | −1.4 |
| 303 | (+) chr 2: 18474209-18474872 | | −1.4 |
| 304 | (+) chr 7: 66718910-66719586 | | 1.4 |
| 305 | (−) chr 21: 27028460-27028873 | | −1.4 |
| 306 | (−) chr 2: 101601994- | | 1.4 |
| 307 | (−) chr 4: 59057092-59057870 | | −1.4 |
| 308 | (+) chr 7: 100353142- | | 1.4 |
| 309 | (+) chr 11: 58524024-58529760 | | 1.4 |
| 310 | (+) chr 3: 46140179-46140255 | | 1.4 |
| 311 | (−) chr X: 112238600- | | 1.4 |
| 312 | (+) chr 9: 34993290-34999332 | | 1.4 |
| 313 | (−) chr 10: 92051390-92052344 | | −1.4 |
| 314 | (+) chr 19: 23528001-23529694 | | 1.4 |
| 315 | (−) chr 10: 23719462-23720038 | | 1.3 |
| 316 | (+) chr 9: 15409320-15410036 | | 1.3 |
| 317 | (+) chr 10: 13383338-13383595 | | −1.3 |
| 318 | (+) chr 16: 56798947-56799017 | | 1.3 |
| 319 | (−) chr 15: 19500293-19500872 | | 1.3 |
| 320 | (+) chr 17: 19640286-19640712 | | −1.3 |
| 321 | (−) chr 4: 135818540- | | 1.3 |

TABLE-continued

| SEQ ID NO: | Chromosomal location | Target tissue | Cancer/normal expression ratio |
|---|---|---|---|
| 322 | (+) chr 5: 108685641- | | −1.3 |
| 323 | (+) chr 3: 83648234-83648933 | | 1.3 |
| 324 | (−) chr 1: 210389154- | | 1.3 |
| 325 | (−) chr 1: 36727172-36729315 | | −1.3 |
| 326 | (+) chr 3: 133850331- | | −1.3 |
| 327 | (+) chr 2: 71468737-71476455 | | −1.3 |
| 328 | (−) chr 2: 69523645-69529977 | | −1.3 |
| 329 | (−) chr 19: 20128147-20129118 | | 1.3 |
| 330 | (+) chr 3: 153797495- | | 1.3 |
| 331 | (−) chr X: 107838-108808 | | 1.3 |
| 332 | (+) chr 1: 65378067-65379033 | | −1.3 |
| 333 | (−) chr 4: 138339335- | | 1.3 |
| 334 | (−) chr 6: 68639470-68641070 | | 1.3 |
| 335 | (−) chr 16: 69214387-69217522 | | 1.3 |
| 336 | (−) chr 1: 205873717- | | 1.3 |
| 337 | (−) chr Y: 12999559-12999968 | | −1.3 |
| 338 | (−) chr 10: 32280890-32281905 | | −1.3 |
| 339 | (−) chr 3: 68563582-68564080 | | −1.3 |
| 340 | (+) chr 4: 8472992-8480379 | | 1.3 |
| 341 | (−) chr 7: 27747804-27748772 | | −1.3 |
| 342 | (+) chr 8: 72749726-72755451 | | 1.3 |
| 343 | (−) chr 9: 116976750- | | 1.3 |
| 344 | (−) chr 2: 202508160- | | 1.3 |
| 345 | (+) chr 16: 10294212-10296592 | | 1.3 |
| 346 | (−) chr 2: 105967906- | | 1.3 |
| 347 | (−) chr 2: 98027450-98028453 | | 1.3 |
| 348 | (+) chr 7: 100357831- | | 1.3 |
| 349 | (+) chr 8: 98256433-98262143 | | 1.3 |
| 350 | (+) chr 9: 79145953-79146072 | | 1.3 |
| 351 | (−) chr 7: 128961001- | | 1.3 |
| 352 | (−) chr Y: 14976683-14981289 | | −1.3 |
| 353 | (−) chr 13: 88856202-88856780 | | −1.3 |
| 354 | (+) chr 1: 204107496- | | −1.3 |
| 355 | (+) chr 2: 170676773- | | 1.3 |
| 356 | (−) chr 5: 37820710-37821012 | | −1.3 |
| 357 | (+) chr 3: 40577391-40583175 | | 1.3 |
| 358 | (+) chr 15: 33670273-33670510 | | 1.3 |
| 359 | (−) chr 1: 194451065- | | 1.3 |
| 360 | (+) chr 21: 18019170-18019257 | | 1.3 |
| 361 | (−) chr 6: 24784895-24791307 | | 1.3 |
| 362 | (+) chr 4: 8486531-8489137 | | −1.3 |
| 363 | (+) chr 1: 4781688-4782412 | | 1.3 |
| 364 | (−) chr 7: 48049968-48050752 | | 1.3 |
| 365 | (+) chr 22: 31228741-31234490 | | 1.3 |
| 366 | (+) chr 6: 149002601- | | −1.3 |
| 367 | (−) chr 11: 67377518-67381008 | | 1.3 |
| 368 | (+) chr 1: 70826708-70832264 | | −1.3 |
| 369 | (−) chr 7: 149362156- | | 1.3 |
| 370 | (+) chr 3: 191345083- | | 1.3 |
| 371 | (+) chr 4: 157740798- | | −1.3 |
| 372 | (+) chr 2: 199752333- | | −1.3 |
| 373 | (+) chr 6: 130555149- | | −1.3 |
| 374 | (+) chr 8: 7247222-7250906 | | −1.3 |
| 375 | (−) chr 2: 58194071-58199769 | | 1.3 |
| 376 | (+) chr 18: 46153554-46153955 | | 1.3 |
| 377 | (+) chr 5: 43015565-43018176 | | 1.3 |
| 378 | (−) chr 1: 20280815-20281721 | | −1.3 |
| 379 | (−) chr 7: 52362517-52362663 | | 1.3 |
| 380 | (+) chr 19: 17565375-17569904 | | 1.3 |
| 381 | (−) chr 12: 30100281-30106718 | | −1.3 |
| 382 | (−) chr 15: 39364817-39365176 | | −1.3 |
| 383 | (+) chr 3: 163923299- | | 1.3 |
| 384 | (−) chr 3: 48735692-48742987 | | −1.3 |
| 385 | (+) chr 3: 9864346-9867038 | | 1.3 |
| 386 | (+) chr 21: 44461476-44462142 | | 1.3 |
| 387 | (+) chr 12: 34314239-34318461 | | 1.3 |
| 388 | (−) chr 5: 18704707-18710464 | | −1.3 |
| 389 | (+) chr 7: 39726352-39726804 | | 1.3 |
| 390 | (+) chr 7: 35702274-35703153 | | 1.3 |
| 391 | (+) chr 8: 136848614- | | 1.3 |
| 392 | (−) chr 20: 54220244-54221269 | | −1.3 |
| 393 | (+) chr 4: 151308190- | | 1.3 |
| 394 | (−) chr 2: 127843921- | | −1.3 |
| 395 | (+) chr 3: 186986788- | | 1.3 |
| 396 | (−) chr X: 72941188-72945945 | | −1.3 |
| 397 | (−) chr 12: 66446853-66452393 | | −1.3 |
| 398 | (+) chr 7: 82926920-82932637 | | −1.3 |
| 399 | (−) chr 18: 38386402-38392105 | | −1.3 |
| 400 | (+) chr 2: 209475743- | | −1.3 |
| 401 | (+) chr 15: 81168183-81174208 | | −1.3 |
| 402 | (−) chr 20: 23789232-23790195 | | 1.3 |
| 403 | (+) chr 13: 55144122-55144740 | | −1.3 |
| 404 | (+) chr X: 138586657- | | −1.2 |
| 405 | (+) chr 1: 227155887- | | −1.2 |
| 406 | (+) chr 4: 68579259-68585888 | | 1.2 |
| 407 | (−) chr X: 137174181- | | −1.2 |
| 408 | (+) chr X: 30031651-30037293 | | 1.2 |
| 409 | (+) chr X: 153791448- | | −1.2 |
| 410 | (−) chr 12: 33132053-33135058 | | −1.2 |
| 411 | (−) chr 15: 18488924-18489503 | | 1.2 |
| 412 | (+) chr 2: 179035945- | | 1.2 |
| 413 | (+) chr 5: 43093994-43094958 | | −1.2 |
| 414 | (−) chr 11: 67365951-67369209 | | 1.2 |
| 415 | (−) chr 2: 187305381- | | −1.2 |
| 416 | (+) chr 19: 58554156-58559856 | | 1.2 |
| 417 | (+) chr 2: 36679747-36685410 | | −1.2 |
| 418 | (+) chr 3: 143021313- | | 1.2 |
| 419 | (−) chr 8: 56851123-56851350 | | 1.2 |
| 420 | (+) chr 1: 207713890- | | 1.2 |
| 421 | (−) chr 1: 201241191- | | 1.2 |
| 422 | (+) chr 3: 116946112- | | −1.2 |
| 423 | (−) chr 6: 78424455-78432877 | | −1.2 |
| 424 | (−) chr 10: 86314943-86315696 | | 1.2 |
| 425 | (+) chr X: 115379535- | | −1.2 |
| 426 | (+) chr 18: 49536517-49537209 | | 1.2 |
| 427 | (−) chr Y: 13181166-13187309 | | −1.2 |
| 428 | (−) chr 10: 9461231-9461724 | | 1.2 |
| 429 | (−) chr 13: 83508263-83508914 | | 1.2 |
| 430 | (−) chr 5: 121980485- | | 1.2 |
| 431 | (−) chr 12: 91257229-91258011 | | 1.2 |
| 432 | (−) chr 3: 170033623- | | 1.2 |
| 433 | (−) chr 15: 22481598-22487267 | | −1.2 |
| 434 | (+) chr 15: 50517982-50518757 | | −1.2 |
| 435 | (+) chr 3: 147554294- | | −1.2 |
| 436 | (+) chr 8: 120998753- | | −1.2 |
| 437 | (+) chr 3: 78353823-78354204 | | 1.2 |
| 438 | (−) chr 20: 3962724-3963629 | | −1.2 |
| 439 | (+) chr 16: 54225830-54226967 | | −1.2 |
| 440 | (−) chr 10: 52210114-52210776 | | −1.2 |
| 441 | (+) chr 5: 98593423-98593800 | | −1.2 |
| 442 | (−) chr 21: 41718929-41719369 | | 1.2 |
| 443 | (+) chr 4: 146973214- | | 1.2 |
| 444 | (−) chr X: 148516015- | | 1.2 |
| 445 | (+) chr 1: 161827723- | | 1.2 |
| 446 | (−) chr 14: 24964620-24969975 | | −1.2 |
| 447 | (+) chr 11: 321893-322552 | | −1.2 |
| 448 | (−) chr X: 89718079-89718557 | | −1.2 |
| 449 | (+) chr 6: 119115236- | | −1.2 |
| 450 | (−) chr 2: 44099248-44105173 | | 1.2 |
| 451 | (−) chr 18: 1990815-1991782 | | 1.2 |
| 452 | (+) chr 10: 65936583-65936972 | | 1.2 |
| 453 | (−) chr 11: 77247021-77252169 | | 1.2 |
| 454 | (−) chr 12: 45932745-45933508 | | 1.2 |
| 455 | (−) chr 12: 17764451-17768938 | | 1.2 |
| 456 | (+) chr 11: 6343834-6349468 | | −1.2 |
| 457 | (+) chr 13: 43180036-43180733 | | 1.2 |
| 458 | (+) chr 7: 65695119-65695525 | | 1.2 |
| 459 | (−) chr 5: 146727162- | | −1.2 |
| 460 | (+) chr 14: 46643150-46647720 | | 1.2 |
| 461 | (−) chr 2: 101341556- | | 1.2 |
| 462 | (−) chr 1: 209462097- | | 1.2 |
| 463 | (+) chr 14: 25196411-25196706 | | −1.2 |
| 464 | (−) chr 13: 19604221-19604442 | | −1.2 |
| 465 | (−) chr 1: 71574420-71575497 | | 1.2 |
| 466 | (−) chr 3: 144273854- | | 1.2 |
| 467 | (−) chr 7: 68382377-68383085 | | −1.2 |
| 468 | (−) chr 18: 68050597-68051144 | | 1.2 |
| 469 | (+) chr 11: 67283732-67289415 | | 1.2 |
| 470 | (−) chr 3: 90214824-90218570 | | −1.2 |
| 471 | (−) chr 5: 135094585- | | 1.2 |
| 472 | (−) chr 4: 175540733- | | −1.2 |
| 473 | (−) chr 2: 47832401-47832875 | | −1.2 |
| 474 | (+) chr 11: 104640788- | | −1.2 |
| 475 | (−) chr 12: 20862483-20866818 | | 1.2 |

TABLE-continued

| SEQ ID NO: | Chromosomal location | Target tissue | Cancer/normal expression ratio |
|---|---|---|---|
| 476 | (−) chr 9: 138794598- | | −1.2 |
| 477 | (+) chr 1: 45554293-45558755 | | −1.2 |
| 478 | (+) chr 12: 122598918- | | 1.2 |
| 479 | (−) chr 2: 231220016- | | 1.2 |
| 480 | (−) chr 19: 57024203-57024671 | | 1.2 |
| 481 | (+) chr 21: 14114072-14115040 | | 1.2 |
| 482 | (+) chr 8: 81814506-81817982 | | −1.2 |
| 483 | (+) chr 13: 62685327-62691268 | | −1.2 |
| 484 | (+) chr 3: 163912942- | | 1.1 |
| 485 | (−) chr 6: 111682993- | | −1.1 |
| 486 | (+) chr 7: 85150987-85151764 | | 1.1 |
| 487 | (+) chr 6: 131841491- | | 1.1 |
| 488 | (−) chr 1: 144213068- | | −1.1 |
| 489 | (+) chr 2: 201439950- | | −1.1 |
| 490 | (+) chr 9: 129215427- | | −1.1 |
| 491 | (+) chr 14: 99217652-99218668 | | 1.1 |
| 492 | (+) chr 12: 28874497-28874581 | | 1.1 |
| 493 | (+) chr 3: 95139589-95145594 | | −1.1 |
| 494 | (+) chr 8: 91057690-91058157 | | 1.1 |
| 495 | (+) chr 17: 31491551-31492522 | | −1.1 |
| 496 | (−) chr 2: 167330763- | | 1.1 |
| 497 | (−) chr 3: 100178327- | | −1.1 |
| 498 | (−) chr 2: 239567148- | | −1.1 |
| 499 | (+) chr 18: 27623185-27623837 | | −1.1 |
| 500 | (+) chr 4: 177503741- | | 1.1 |
| 501 | (+) chr 15: 52966922-52970766 | | −1.1 |
| 502 | (−) chr 4: 8535024-8541336 | | −1.1 |
| 503 | (+) chr 3: 38150975-38151716 | | −1.1 |
| 504 | (+) chr 10: 104955188- | | 1.1 |
| 505 | (+) chr 3: 42827687-42828671 | | 1.1 |
| 506 | (+) chr 19: 60921086-60922051 | | 1.1 |
| 507 | (+) chr 12: 60267154-60272981 | | −1.1 |
| 508 | (+) chr 18: 23066222-23066669 | | 1.1 |
| 509 | (−) chr 18: 31472178-31472680 | | −1.1 |
| 510 | (−) chr 4: 190637685- | | 1.1 |

The subject of the present invention is therefore a method for the in vitro diagnosis of ovarian cancer or for the in vitro prognosis of the seriousness of ovarian cancer in a biological sample taken from a human patient, which comprises detecting at least one expression product of at least one nucleic acid sequence, said nucleic acid sequence being chosen from the full-length sequences identified in SEQ ID NOs: 1 to 510 or from the sequences which exhibit at least 99% identity, preferably at least 99.5% identity and advantageously at least 99.6% or at least 99.7% identity with one of the full-length sequences identified in SEQ ID NOs: 1 to 510.

The diagnosis makes it possible to establish whether or not an individual is ill. The prognosis makes it possible to establish a degree of seriousness of the disease (grades and/or stages) which has an effect on the survival and/or quality of life of the individual. In the context of the present invention, the diagnosis may be very early.

The percentage identity described above has been determined by taking into consideration the nucleotide diversity in the genome. It is known that nucleotide diversity is higher in regions of the genome that are rich in repeat sequences than in regions which do not contain repeat sequences. By way of example, Nickerson D. A. et al. (1) have shown a diversity of approximately 0.3% (0.32%) in regions containing repeat sequences.

The ability to discriminate a cancerous state of each of the sequences identified above has been demonstrated by means of a statistical analysis using the SAM procedure (5), followed by correction by means of the rate of false positives (6) and by elimination of the values below $2^6$. Consequently, each of the sequences identified above exhibits a significant difference in expression between a tumor state and a normal state. As a result of this, a difference in expression observed for one of the abovementioned sequences constitutes a signature of the pathological condition. Of course, it is possible to combine the differences in expression noted for several of the sequences referenced above for example by one or more combinations of 2, 3, 4, 5, 6, 7, 8, 9, 10 and more up to 510 of the listed sequences. In particular, the sequences identified in SEQ ID NOs: 1, 17 and 29, taken alone or in combination (in pairs or all three) constitute one or more preferred signatures.

Thus, in the method of the invention, at least two expression products respectively of at least two nucleic acid sequences are detected, said nucleic acid sequences being chosen from the sequences identified in SEQ ID NOs: 1 to 510 or from the sequences which exhibit at least 99% identity, preferably at least 99.5% identity and advantageously at least 99.6% or at least 99.7% identity with one of the sequences identified in SEQ ID NOs: 1 to 510.

In one embodiment of the method according to the invention, the expression product of at least two nucleic acid sequences is detected, said at least two nucleic acid sequences being chosen from the sequences identified as being specific for ovarian tissue, i.e. chosen from the group of sequences identified in SEQ ID NOs: 2, 3, 6, 9, 10, 11, 20, 23, 24, 25, 26, 30, 34, 59 and 139, in particular the sequences chosen from the sequences identified in SEQ ID NOs: 2, 3 and 6 or from the sequences which exhibit at least 99% identity, preferably at least 99.5% identity and advantageously at least 99.6% or at least 99.7% identity with one of the sequences identified in SEQ ID NOs: 2, 3, 6, 9, 10, 11, 20, 23, 24, 25, 26, 30, 34, 59 and 139, in particular from the sequences which exhibit at least 99% identity, preferably at least 99.5% identity and advantageously at least 99.6% or at least 99.7% identity with one of the sequences identified in SEQ ID NOs: 2, 3 and 6.

In one embodiment of the method according to the invention, the expression product of at least two nucleic acid sequences is detected, said at least two nucleic acid sequences being chosen from the sequences identified as being not specific for ovarian tissue, i.e. chosen from the group of sequences identified in SEQ ID NOs 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510, in particular the sequences chosen from the sequences identified in SEQ ID NOs 1, 17 and 19, or from the sequences which exhibit at least 99% identity, preferably at least 99.5% identity and advantageously at least 99.6% or at least 99.7% identity with one of the sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510, in particular from the sequences which exhibit at least 99% identity, preferably at least 99.5% identity and advantageously at least 99.6% or at least 99.7% identity with one of the sequences identified in SEQ ID NOs: 1, 17 and 19.

In yet another embodiment of the invention, the expression product of at least one sequence chosen from the sequences identified as being specific for ovarian tissue, i.e. chosen from the group of sequences identified in SEQ ID NOs: 2, 3, 6, 9, 10, 11, 20, 23, 24, 25, 26, 30, 34, 59 and 139, or chosen from the sequences which exhibit at least 99% identity, preferably at least 99.5% identity and advantageously at least 99.6% or at least 99.7% identity with one of the sequences identified in SEQ ID NOs: 2, 3, 6, 9, 10, 11, 20, 23, 24, 25, 26, 30, 34, 59 and 139 and the expression product of at least one sequence chosen from the sequences identified as being not specific for ovarian tissue, i.e. chosen from the group of sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510 or chosen from the sequences which exhibit at least 99% identity, preferably at least 99.5% identity and advantageously at least 99.6% or at least 99.7% identity with one of the sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510, are detected.

Preferably, in the method of the invention, the expression product of at least one nucleic acid sequence, preferably of at least two nucleic acid sequences or of three nucleic acid sequences is detected, said nucleic acid sequences being chosen from the group of sequences identified in SEQ ID NOs: 1, 17 and 29, or from the sequences which exhibit at least 99% identity, preferably at least 99.5% identity and advantageously at least 99.6% or at least 99.7% identity with the sequences identified in SEQ ID NOS: 1, 17 and 29.

The expression product detected is at least one RNA transcript, in particular at least one mRNA or at least one polypeptide.

When the expression product is an mRNA transcript, it is detected by any appropriate method, such as hybridization, sequencing or amplification. The mRNA may be detected directly by bringing into contact with at least one probe and/or at least one primer which are designed so as to hybridize to the mRNA transcripts under predetermined experimental conditions, demonstrating the presence or the absence of hybridization to the mRNA and optionally quantifying the mRNA. Among the preferred methods, mention may be made of amplification (for example, RT-PCR, NASBA, etc.), hybridization on a chip or else sequencing. The mRNA may also be detected indirectly using nucleic acids derived from said transcripts, such as cDNA copies, etc.

Generally, the method of the invention comprises an initial step of extracting the mRNA from the sample to be analyzed.

Thus, the method may comprise:
(i) a step of extracting the mRNA from the sample to be analyzed,
(ii) a step of detecting and quantifying the mRNA from the sample to be analyzed,
(iii) a step of extracting the mRNA in a reference sample, which may be a healthy sample originating in the same individual, or
(iv) a step of detecting and quantifying the mRNA from the healthy sample,
(v) a step of comparing the amount of mRNA expressed in the sample to be analyzed and in the reference sample; it being possible for the determination of an amount of mRNA expressed in the sample to be analyzed which is different than the amount of mRNA expressed in the healthy reference sample to be correlated with the diagnosis or the prognosis of the seriousness of ovarian cancer (the difference in the amount of mRNA in the cancerous ovarian tissue relative to the amount of mRNA expressed in the healthy ovarian tissue being indifferently an expression, an overexpression or an underexpression);
and in particular:
(i) an extraction of the mRNA to be analyzed from the sample,
(ii) a determination, in the RNA to be analyzed, of an expression level of at least one RNA sequence in the sample, said RNA sequence being the transcription product of at least one nucleic acid sequence chosen from the sequences identified in SEQ ID NOs: 1 to 510 or from the sequences which exhibit at least 99% identity, preferably at least 99.5% identity and advantageously at least 99.6% or at least 99.7% identity with one of the sequences identified in SEQ ID NOs: 1 to 510, and
(iii) a comparison of the expression level of the RNA sequence(s) defined in (ii) with a reference expression level; it being possible for the determination of an expression level of the RNA to be analyzed which exhibits a difference relative to the reference expression level to be correlated with the diagnosis or the prognosis of ovarian cancer (as determined above); or
(i) a step of extracting the mRNA from the sample to be analyzed,
(ii) a step of detecting and quantifying the mRNA from the sample to be analyzed,
(iii) a step of comparing the amount of mRNA expressed in the sample to be analyzed relative to an amount of reference mRNA, it being possible for the determination of an amount of mRNA expressed in the sample to be analyzed which is different than the amount of reference mRNA to be correlated with the diagnosis or the prognosis of ovarian cancer (the difference in the amount of mRNA in the sample to be analyzed relative to the amount of reference mRNA being indifferently an expression, an overexpression or an underexpression).

In one embodiment of the method of the invention, DNA copies of the mRNA are prepared, the DNA copies are brought into contact with at least one probe and/or at least one primer under predetermined conditions which allow hybridization, and the presence or absence of hybridization to said DNA copies is detected.

The expression product which is detected may also be a polypeptide which is the translation product of at least one of the transcripts described above. In this case, the polypeptide expressed is detected by bringing into contact with at least one specific binding partner of said polypeptide, in particular an antibody or an antibody analog or an aptamer. The binding partner is preferably an antibody, for example a monoclonal antibody or a polyclonal antibody which is highly purified or an antibody analog, for example an affinity protein with competitive properties (Nanofitin™).

The polyclonal antibodies can be obtained by immunization of an animal with the appropriate immunogen, followed by recovery of the desired antibodies in purified form, by taking the serum of said animal, and separation of said antibodies from the other serum constituents, in particular by affinity chromatography on a column to which an antibody specifically recognized by the antibodies is bound.

The monoclonal antibodies can be obtained by means of the hybridoma technology, the general principle of which is summarized below.

Firstly, an animal, generally a mouse, is immunized with the appropriate immunogen, and the B lymphocytes of said mouse are then capable of producing antibodies against this antigen. These antibody-producing lymphocytes are then fused with "immortal" myeloma cells (murine in the example) so as to give rise to hybridomas. The cells capable of producing a particular antibody and of multiplying indefinitely are then selected from the heterogeneous mixture of cells thus obtained. Each hybridoma is multiplied in the form of a clone, each one resulting in the production of a monoclonal antibody in which the properties of recognition with respect to the protein may be tested, for example, by ELISA, by one-dimensional or two-dimensional Western blotting, by immunofluorescence, or using a biosensor. The monoclonal antibodies thus selected are subsequently purified, in particular according to the affinity chromatography technique described above.

The monoclonal antibodies may also be recombinant antibodies obtained by genetic engineering, using techniques well known to those skilled in the art.

Nanofitins™ are small proteins which, like antibodies, are capable of binding to a biological target, thus making it possible to detect it, to capture it or quite simply to target it within an organism. They are presented, inter alia, as antibody analogs.

Aptamers are synthetic oligonucleotides capable of binding a specific ligand.

The invention also relates to the use of at least one nucleic acid sequence, once isolated, as a molecular marker for the in vitro diagnosis or prognosis of ovarian cancer, characterized in that said nucleic acid sequence consists of:
(i) at least one DNA sequence chosen from the sequences SEQ ID NOs: 1 to 510, or
(ii) at least one DNA sequence complementary to a sequence chosen from the sequences SEQ ID NOs: 1 to 510, or
(iii) at least one DNA sequence which exhibits at least 99% identity, preferably at least 99.5% identity and advantageously at least 99.6% or at least 99.7% identity with a sequence as defined in (i) and (ii), or
(iv) at least one RNA sequence which is the transcription product of a sequence chosen from the sequences as defined in (i), or
(v) at least one RNA sequence which is the transcription product of a sequence chosen from the sequences which exhibit at least 99% identity, preferably at least 99.5% identity and advantageously at least 99.6% or at least 99.7% identity with a sequence as defined in (i).

In one embodiment, use is made of at least two nucleic acid sequences which consist of:
(i) at least two DNA sequences chosen from the sequences SEQ ID NOs: 1 to 510, preferably chosen from the sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510 and in particular the sequences SEQ ID NOs: 1, 17 and 29, or preferably chosen from the sequences identified in SEQ ID NOs: 2, 3, 6, 9, 10, 11, 20, 23, 24, 25, 26, 30, 34, 59 and 139, and in particular chosen from the sequences identified in SEQ ID NOs: 2, 3 and 6, or else at least one DNA sequence chosen from the sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510 and in particular from the sequences SEQ ID Nos: 1, 17 and 29 and at least one DNA sequence chosen from the sequences identified in SEQ ID NOs: 2, 3, 6, 9, 10, 11, 20, 23, 24, 25, 26, 30, 34, 59 and 139, and in particular chosen from the sequences identified in SEQ ID NOs: 2, 3 and 6, or (ii) at least two DNA sequences respectively complementary to at least two sequences as defined in (i), (iii) at least two DNA sequences which exhibit respectively at least 99% identity, preferably at least 99.5% identity and advantageously at least 99.6% or at least 99.7% identity with two sequences as defined in (i) and (ii), or (iv) at least two RNA sequences which are respectively the transcription product of two sequences chosen from the sequences as defined in (i), or (v) at least two RNA sequences which are the transcription product of two sequences chosen from the sequences which exhibit at least 99% identity, preferably at least 99.5% identity and advantageously at least 99.6% or at least 99.7% identity with the sequences as defined in (i).

A subject of the invention is also a kit for the in vitro diagnosis or prognosis of ovarian cancer in a biological sample taken from a patient, which comprises at least one specific binding partner of at least one expression product of at least one nucleic acid sequence chosen from the sequences identified in SEQ ID NOs: 1 to 510 or from the sequences which exhibit at least 99% identity, preferably at least 99.5% identity, advantageously at least 99.6% or at least 99.7% identity with the nucleic acid sequences identified in SEQ ID NOs: 1 to 510 and no more than 510 specific binding partners of the expression products of the nucleic acid sequences identified in SEQ ID NOs: 1 to 510 or of the nucleic acid sequences which exhibit at least 99% identity with the nucleic acid sequences identified in SEQ ID NOs: 1 to 510, preferably at least 99.5% identity and advantageously at least 99.6% or at least 99.7% identity with one of the sequences identified in SEQ ID NOs: 1 to 510.

In one embodiment, the kit comprises at least two respectively specific binding partners of at least two expression products of at least two nucleic acid sequences chosen from the sequences identified in SEQ ID NOs: 1 to 510 or from the sequences which exhibit at least 99% identity, preferably at least 99.5% identity and advantageously at least 99.6% or at least 99.7% identity with the nucleic acid sequences identified in SEQ ID NOs: 1 to 510 and no more than 510 specific binding partners of the expression products of the nucleic acid sequences identified in SEQ ID NOs: 1 to 510 or of the nucleic acid sequences which exhibit at least 99% identity, preferably at least 99.5% identity and advantageously at least 99.6% or at least 99.7% identity with the nucleic acid sequences identified in SEQ ID NOs: 1 to 510.

For example, the kit comprises at least two respectively specific binding partners of the expression product of at least two nucleic acid sequences chosen from:

(i) the group of sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510 and in particular from the group of sequences identified in SEQ ID Nos: 1, 17 and 29, (ii) from the group of sequences identified in SEQ ID NOs: 2, 3, 6, 9, 10, 11, 20, 23, 24, 25, 26, 30, 34, 59 and 139 and in particular from the group of sequences identified in SEQ ID NOs: 2, 3 and 6, or (iii) from the group of sequences consisting of at least one DNA sequence chosen from the sequences identified in SEQ ID NOs: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509 and 510 and in particular the sequences SEQ ID NOs: 1, 17 and 29 and of at least one DNA sequence chosen from the sequences identified in SEQ ID NOs: 2, 3, 6, 9, 10, 11, 20, 23, 24, 25, 26, 30, 34, 59 and 139 and in particular the sequences identified in SEQ ID NOs: 2, 3 and 6, or (iv) from the groups of sequences which exhibit at least 99% identity, preferably at least 99.5% identity and in particular at least 99.6% or 99.7% identity with the sequences identified in the groups of sequences as described in (i), (ii) or (iii).

In particular, the kit comprises 2 or 3 respectively specific binding partners of the expression products of the nucleic acid sequences identified in SEQ ID NOs: 1, 17 and 29 or of the sequences which exhibit at least 99% identity, preferably at least 99.5% and advantageously at least 99.6% or at least 99.7% identity with the sequences identified in SEQ ID NOs: 1, 17 and 29.

Preferably, the kit comprises a specific binding partner of the expression product of at least one nucleic acid sequence chosen from the group of sequences identified in SEQ ID NOs: 1, 17 and 29 or of the sequences which exhibit at least 99% identity, preferably at least 99.5% identity and advantageously at least 99.6% or at least 99.7% identity with the sequences identified in SEQ ID NOs: 1, 17 and 29.

In particular, the kit comprises 1, 2 or 3 specific binding partner(s) of the expression product(s) of the nucleic acid sequences identified in SEQ ID NOs: 1, 17 and 29 or of the sequences which exhibit at least 99% identity, preferably at least 99.5% identity and advantageously at least 99.6% or at least 99.7% identity with the sequences identified in SEQ ID NOs: 1, 17 and 29.

The at least specific binding partner of the expression product corresponds to the definitions given above.

The invention also relates to a method for evaluating the efficacy of a treatment and/or a progression in ovarian cancer, which comprises a step of obtaining a series of biological samples, and a step of detecting at least one expression product of at least one nucleic acid sequence in said series of biological samples, said nucleic acid sequence being chosen from the sequences identified in SEQ ID NOs: 1 to 510, with one of the sequences identified in SEQ ID NOs: 1 to 510 or of the sequences which exhibit at least 99% identity, preferably at least 99.5% identity and advantageously at least 99.6% or at least 99.7% identity with the sequences identified in SEQ ID NOs: 1 to 510. Preferably, the expression product of at least one nucleic acid sequence, preferably of at least two nucleic acid sequences or of three nucleic acid sequences is detected, said nucleic acid sequences being chosen from the group of sequences identified in SEQ ID NOs: 1, 17 and 29 or from the group of sequences which exhibit at least 99% identity, preferably at least 99.5% identity and advantageously at least 99.6% or at least 99.7% identity with the sequences identified in SEQ ID NOs: 1, 17 and 29.

The term "biological sample" is intended to mean a tissue, a fluid, components of said tissue and fluid, such as cells or apoptotic bodies, and excreted vesicles, comprising in particular exosomes and microvesicles. By way of example, the biological sample may be derived from a biopsy of the ovary carried out beforehand in a patient suspected of suffering from ovarian cancer or may be derived from a biopsy carried out on an organ other than the ovary in a patient presenting metastases. In this second case, when the change in expression of the nucleic acid (molecular marker) is specific for the ovarian organ, it is possible to work back to the primary cancer, i.e. to the ovarian cancer. The biological sample may also be a biological fluid, such as blood or a blood fraction (serum, plasma), urine, saliva, cerebrospinal fluid, lymph, maternal milk, sperm, and also components of said fluids, in particular excreted vesicles as defined above. For example, the detection of a transcript specific for the ovarian tissue in an exosome or a microvesicle, originating from an epithelial cell, is a sign of the presence either of a primary cancer or of metastases, without it being necessary to take a sample at the level of the organ.

FIGURES

FIG. 2 shows the statistical differences in expression of HERV elements between normal ovary and tumoral ovary.

EXAMPLES

Example 1

Identification of HERV Sequences Exhibiting Differential Expression in Ovarian Cancer Method:
The identification of HERV sequences exhibiting differential expression in ovarian cancer is based on the design and the use of a high-density DNA chip in the GeneChip format, called HERV-V2, designed by the inventors and the fabrication of which was subcontracted to the company Affymetrix. This chip contains probes which correspond to HERV sequences that are distinct within the human genome. These sequences were identified using a set of prototypical references cut up into functional regions (LTR, gag, pol and env), and then, by means of a similarity search on the scale of the whole human genome (NCBI 36/hg18), 10 035 distinct HERV loci were identified, annotated and finally grouped together in a databank called HERVgDB3.

The probes which are part of the composition of the chip were defined on the basis of HERVgDB3 and selected by applying a hybridization specificity criterion, the objective of which is to exclude, from the creation process, the probes having a high risk of hybridization with an undesired target. For this, the HERVgDB3 sequences were first segmented in sets of 25 overlapping nucleotides (25-mers), resulting in a set of candidate probes. The risk of nonspecific hybridization was then evaluated for each candidate probe by performing alignments on the whole of the human genome using the KASH algorithm (2). An experimental score marks the result of the hybridization, addition of the impact of the number, of the type and of the position of the errors in the alignment. The value of this score correlates with the target/probe hybridization potential. Knowledge of all the hybridization potentials of a candidate probe on the whole of the human genome makes it possible to evaluate its capture specificity. The candidate probes which exhibit good capture affinity are retained and then grouped together in "probe sets" and, finally, synthesized on the HERV-V2 chip.

The samples analyzed using the HERV-V2 high-density chip correspond to RNAs extracted from tumors and to RNAs extracted from the healthy tissues adjacent to these tumors. The tissues analyzed are the ovary, with breast, colon, uterus, prostate, lung, testicle and placenta as controls. In the case of placenta, only healthy tissues were used. For each sample, 50 ng of RNA were used for the synthesis of cDNA using the amplification protocol known as WTO. The principle of WTO amplification is the following: random primers, and also primers targeting the 3' end of the RNA transcript, are added, before a step of reverse transcription followed by a linear, single-stranded amplification denoted SPIA. The cDNAs are then assayed, characterized and purified, and then 2 μg are fragmented, and labeled with biotin at the 3' end via the action of the terminal transferase enzyme. The target product thus prepared is mixed with control oligonucleotides, then the hybridization is carried out according to the protocol recommended by the company Affymetrix. The chips are then visualized and read in order to acquire the image of their fluorescence. A quality control based on standard controls is carried out, and a set of indicators (MAD, MAD-Med plots, RLE) serve to exclude the chips that are not in accordance with a statistical analysis.

The analysis of the chips first consists of a preprocessing of the data through the application of a correction of the background noise based on the signal intensity of tryptophan probes, followed by RMA normalization (3) based on the quantile method. A double correction of the effects linked to the batches of experiments is then carried out by applying the COMBAT method (4) in order to guarantee that the differences in expression that are observed are of biological and not technical origin. At this stage, an exploratory analysis of the data is conducted using tools for grouping together data by Euclidean partitioning (clustering) and, finally, a statistical analysis using the SAM procedure (5) followed by a correction via the rate of false positives (6) and elimination of the values below $2^6$ is applied in order to search for sequences exhibiting a differential expression between the normal state and the tumor state of a tissue.

Results:

The processing of the data generated by the analysis of the HERV-V2 DNA chips using this method made it possible to identify a set of "probe sets" exhibiting a statistically significant difference in expression between the normal ovary and the tumoral ovary. The results of the clustering and also the search for differential expression within the control samples moreover demonstrated HERV elements of which the differential expression is specifically associated with the tumoral ovary.

The nucleotide sequences of the HERV elements exhibiting a differential expression in the tumoral ovary are identified by SEQ ID NOs: 1 to 510, the chromosomal location of each sequence is given in the NCBI reference 36/hg18, and the "target tissue" information (a cross) indicates the elements in which the differential expression was observed only in the comparison between normal ovary and tumoral ovary (compared with the comparisons within the control tissues). A value which is an indication of the ratio of expression between normal state and tumor state is also provided, and serves to order the sequences in the interests of presentation only.

Example 2

Detection of HERV Sequences in Biological Fluids

Principle:

The inventors have shown that HERV sequences are detected in biological fluids, which makes it possible, inter alia, to characterize an ovarian cancer through recourse to remote detection of the primary organ. A study was carried out on 20 urine samples and 38 serum samples originating from different individuals.

The sera and the urines were centrifuged under the following conditions:

Sera: 500 g for 10 minutes at 4° C. The supernatant was recovered and centrifuged again at 16 500 g for 20 minutes at 4° C. The supernatant of this second centrifugation, devoid of cells, but also comprising exosomes, microvesicles, nucleic acids and proteins, was analyzed on chips. The chip is the HERV-V2 chip used according to the modes previously described.

Urines: after collection, centrifugation at 800 g for 4 minutes at 4° C. The pellet was recovered with RNA protect cell Reagent™, Then, centrifugation at 5000 g for 5 minutes before addition of the lysis buffer to the pellet. The chip is the HERV-V2 chip used according to the modes previously described.

Figure 1:
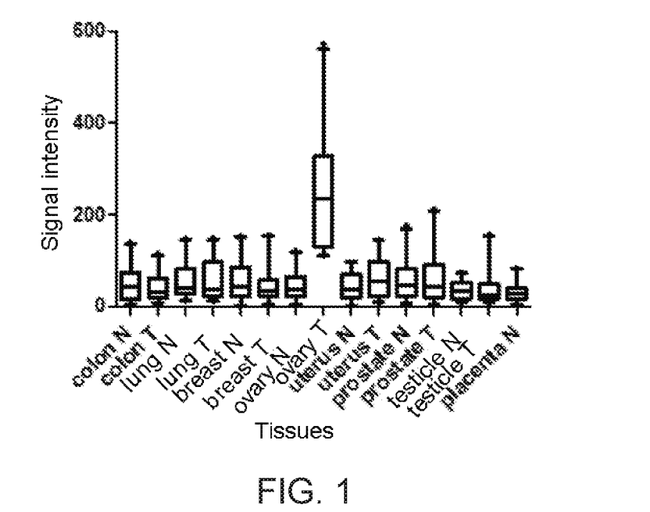
FIGS. 1 and 2 represent the differential expression observed in ovarian cancer for a set of HERV sequences. More specifically, FIG. 1 (clustering) groups together in an exploratory manner the HERV elements which have an expression tropism associated with ovarian cancer compared with all the control tissues.
Figure 2:
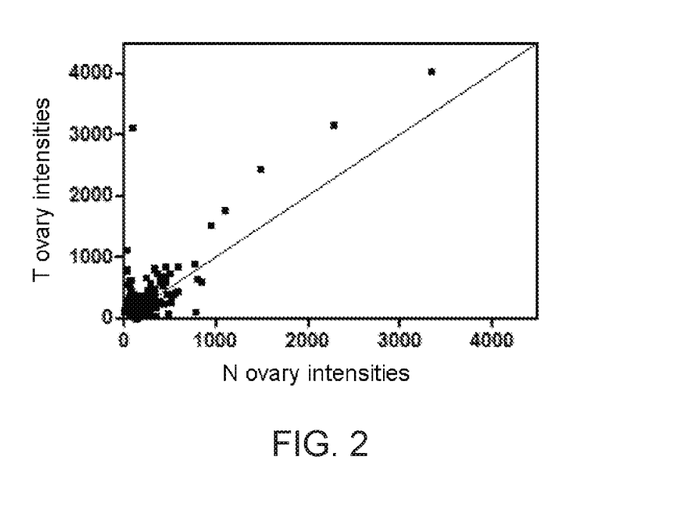
Figure 3:
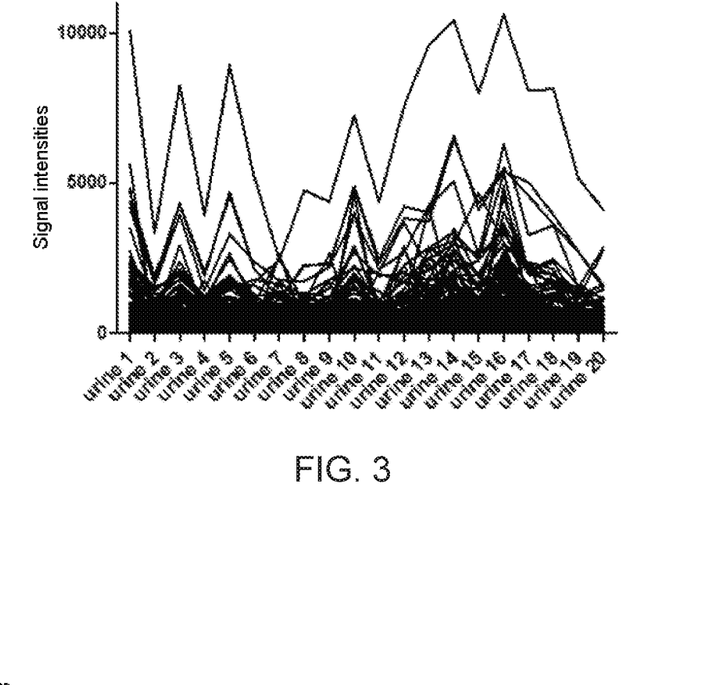
FIGS. 3 and 4 show the detection of HERV sequences in two biological fluids: urines and sera.
Figure 4:
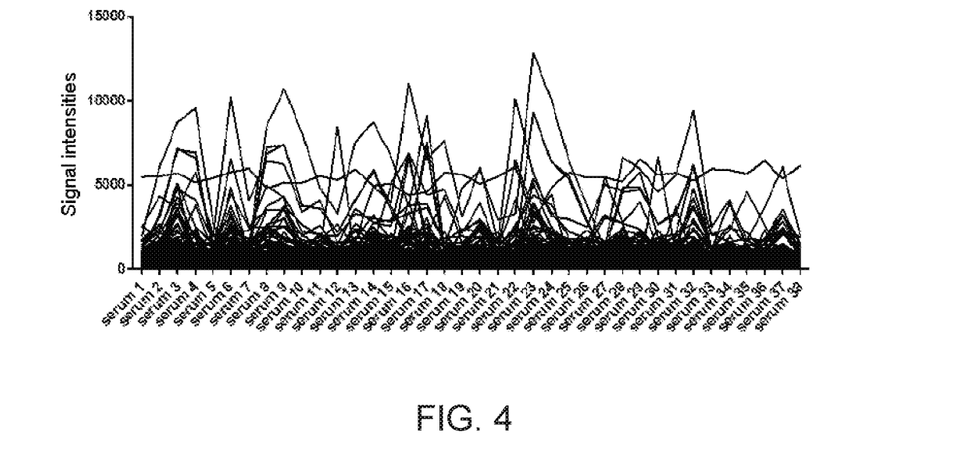

Results:

A large number of positive signals, including the expression signals corresponding to the sequences listed in the table above, was detected both in the serum supernatants and in the cell pellets originating from urines, as illustrated in FIGS. 3 and 4. This confirms that biological fluids, in particular serum and urine, are a usable source of biological material for the detection of HERV sequences. It is commonly accepted that the positivity threshold is about $2^6$, i.e. 64.

LITERATURE REFERENCES

1. Nickerson, D. A., Taylor, S. L., Weiss, K. M., Clark, A. G., Hutchinson, R. G., Stengard, J., Salomaa, V., Vartiainen, E., Boerwinkle, E. and Sing, C. F. (1998) DNA sequence diversity in a 9.7-kb region of the human lipoprotein lipase gene. *Nat. Genet.*, 19, 233-240.
2. Navarro, G. and Raffinot, M. (2002) Flexible Pattern Matching in Strings: Practical On-Line Search Algorithms for Texts and Biological Sequences. Cambridge University Press.
3. Irizarry, R. A., Hobbs, B., Collin, F., Beazer-Barclay, Y. D., Antonellis, K. J., Scherf, U. and Speed, T. P. (2003) Exploration, normalization, and summaries of high density oligonucleotide array probe level data. *Biostatistics (Oxford, England)*, 4, 249-264.
4. Johnson, W. E., Li, C. and Rabinovic, A. (2007) Adjusting batch effects in microarray expression data using empirical Bayes methods. *Biostatistics (Oxford, England)*, 8, 118-127.
5. Tusher, V. G., Tibshirani, R. and Chu, G. (2001) Significance analysis of microarrays applied to the ionizing radiation response. *Proceedings of the National Academy of Sciences of the United States of America*, 98, 5116-5121.
6. Storey, J. D. and Tibshirani, R. (2003) Statistical significance for genomewide studies. *Proceedings of the National Academy of Sciences of the United States of America*, 100, 9440-9445.

SEQUENCE LISTING (510 sequences)

SEQ ID NO: 1 - DNA, 2771 bp, Homo sapiens
tgggtcaggtacaaataagcccaccccactaggaactatgttaaaaaaaaattcaagaaagaatttaagggagattacagtgttactgtgacaccaggaaaacttagaactttgtgtgaaatagactggccagcattagaggtgggttggccatcagaaggaagcctggacaggtcccttgtttcaaaggtatgacacaaggtaacccgtaagccaaggcacccagaccagtttccatacatagaaagttacagctgcttttatacccccttgccccgccaacgtagttaagagaacagcagcataagcggctggcagaggcaaggaaagaccagtagagagaaaaaaaggccatctataccaattctaagttaatttagactaaacaaggtcttaatagcaaaggataattgaaatcccaaacttacaaggttttcaacaaaagtgaagtttgcttaaagttaacagtgtaacatgtattatggtaacttctaatcttgtggccttagacagtctagtccaaaggcataaagaaagtttgctttaaaaaaaaaaaaaaggaatggttatcttcaaaaaaaaaaaaagtggggggagacagaatttatgtaaaaagagtgttatatggtaaattcttgtcctgaaataaactaactggtgtttaaagaaaaaaaatgtttgtaataagtcagaaagttgagacacattgaagaattgtcggcaaaagtcgtgaaagaaaaaatgttataaaaaaatttatgcaaaaaatgttgtataatttaaaagtaataaggcctcctgagtactattaaaaaaacagtttatgtgcaaggtgtataagaaaagtaaaacatacctttggtaaaaagattataaaggggcataagaatgtggatttttacctacattaaaaggttaaaaacaattattgttttaaaagtttaagcaagttttaaaacgttaattataaagaaaattctgtgtgtaaacatattagctaaagttaaaaaggtatcatccagtttttctgtgaactggacattaaagtaaaaaatgccacaggtttttcttaaagcatcaacctgctctttaacaaaaattataaaaggttaaaaagagtctataaaatcttaccttatggtcaaacatgaaaaattggataaatatgtctacaaggttttattaaaattcagtttaaaattaataacacactaatataaaggtaaaatttagcttatctggtataaaaatcatacaagaaacattattaaatataaaatggtgtttagctttctttggtctaaaaactaataaaaattggtgctaaaggaaacattcattttactagaggatcataaaagttaaagacttaaaacaaactttggcaattaagacagcacgccaagatgcaagtgcctggctgaaatggatcaaatattccatctgcactttaaacaaatgcaattgttatgcttgtgcacatggcaggccagaggccctgattgtcccccttccactaaggtggtcctccagttgaccaggcatgggctgcagggtagctattttccaggtttctacagcttggagtaataagtcatgccaagctctctctgctatatcccaaagtccctgcgggtcagcccctgagggccgtccagcttccgtctcccaacactaagttcacttcatgtctctcatggcagggaggagacttagcattccttggagacctgaagggatgcagtgagcttaagaattttcaagagcttatcagtcagtcagcccttgttcatccccgagcggatgtgtgatggtattgtcgtggacctttattgggcactctgccgaataactagagtggcacttgtgctttagcctatttggctatccctttcaccctggcatttcatcaaccagaggaaggaaaaaaaaaataataagacatcgtaaagcgagagaagccccttatgggtctttcaactctcacatctatttagatgcaatcgaagccccgcaaggaacaccagatcaatttaaagtccgaaatcaaatagctacaggatttaagtcaatattttggtagatgacagtcaataaaaatgtagattagataaactgcatctattacacccaacagcaatgagcttttcatgagttgaaaaaaagaaaaaacccatgtcggccccagccctggggctacctgacctgacaaaaccttttacactctatgtgtcagaaagagaaaaagtggcagttggagttttaacccagactgtagggccctggccaaggccagtggcctatctctcaaaacaactagatgaggtttccaaacgctggcccccatgtccaaagtccctggtagcaatagccctgttagcacaagaagcagataagctaactcttagacaaaacctaaacataaagtccccctatgctgtggtgattttaataaataccaaaggacaccattagctaatgaatgctagactagctagataccaaagcttgctctgtgaacatccccgcataaccattgaagtttgcaacacctaaaccccgccaccttcctcccggtgtcagagagcccagttaaacataactgtgtagaggtattggactcagtttattctagtgggcctaaccaccgagaccatccttaaacatcagtagactgggagctgtacatggatgggagcagcttcaccaacccctgcaaagtgactctgaagaagacgacaagccctgctccagtcacacccggaagctga

SEQ ID NO: 2 - DNA, 493 bp, Homo sapiens
ccggcctgccagcccatgctctgatgttaatgacatcgaaggcacccctcccgaggaaatctcaactgcacaacccctactacaccccaattcaacaggaagcagttagagcgttcattggccaacctccccaacagcacttgggttttcctgttgagagggggtactgagagacaggactacctggatttcctaggccgactaagaatccctaagcctagctgggaaggtgaccgcatccacctttaaacacggggcttgaaacttagttcacacccaaccaatcagagagctcactaaaatgctaattaggcaaaagcaggagataaataaatagccaatcatctattgcctgagagcacagtgggagggacaaggatcgggatataaacccaggcatttgagccagcaacggcaaccccctttgggtcccctcccgttgtatgggagctctgttttcactctatttcactctattaaatcttgcaactgc

SEQ ID NO: 3 - DNA, 3667 bp, Homo sapiens
gtcaggcctctgagcccaagccaagccatcgcatcccctgtgacttgcatgtatacgcccagatggcctgaagtaactgaagaatcacaaaagaagtgaatacgccctgcccccaccttaactgatgacattccaccacaaaagaagtgtaaatggtcggtccttgccttaagtgatgacattaccttgaagtccttttcctagctcatcctggctcaaaaagcacccccactgagcaccttgcgacccccactcctgcccaccagagaacaaaccccctttaactataattttcctttacctacccaaatcctataaaacggccccacccttatctcgcttcactgactctcttttcggactcagcccgcctgcacccaggtgaaataaacagccatgttgctcacacaaagcctgtttggtggtctcttcacacagatgcacatgaaatttggtgccgtgactcggattgggggacctcccttgggagatcaatcccctgtactcctgttctttgctccgtgagaaagatccacctatgaccctcaggtcctcagaccgactagcccaaggaacatctcaccaattttaaatcaggtaagcagcctcttcttactctcttctccaacctctctcactgtccctcaaccactttatcctttccactcttcaatctctcccttctcttaatttcaattcctttcattttctgggagagacaaaggagacacgttttatccgtggacccaaaactctggcgcgggtcacggactgggaaggcagccttcccttggtgtttaatcattgcagggacacctctctgattatacacccatgtttcaagggtgtcagaccacgcagggacgcctgccttggtccttcacccttagcggcaagtcccgcttttctggggaaggggcaagtaccccagccccttctctccatgtctctaccccttctctgcttttctgggagaggggcaagtaccctcaacccattctccttcacccttactggcaagtcccacttttctaggaggggggcaagtacccctcaaccccttctccttcacccttagcggcaagtcctgcttttctatggggcaagaaccaccaatcccttatttccatgccccaacctcttatctctgtgccccaatcccttattcctgtgccccaacctatctctgcaccccaatcccttatttccgtgccccaacctcttatatctttgtaccccaatcccttatttccacaccctgacctcttatctctgcaccccaaccccttttcccacttttctggaaggtaagaacccccaaacccttccctccatttctctactctctcttttctctaggcttgcttccttcactatgggaaccttccaccctccattcctcctcctactcccttggcctgtgttctcaaaaacttaaaacctcttcaactcacacctgacctaaaacctaaatgccttattttcttctgcaataccgcttgaccccaatacaaactcgacagtagttccaaatagccagaaaatggcactttgaatttttcaatcctgcaaaatctaaataattcttgtaaaataggcaaacggtctgaggtgcctgacgtccaggcattcttttacacatcagtcccttcctagcctctgtgcccagtgcaactcatcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctacaatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcgtttggcagcaaccctgagacactttacagccctagaccctaaaaggtcaaaaggccatcttattctcaaaatacattttattacccaatctgctcccgacattaaataaaactccaaaaattggaatctggccctcaaaccccacaacaggacttaattaacctcaccttcaaggtgtacaataactgaaaaaagttgcaattccttgcctccactgtgagacaaaccccagccacatctccagcacacaagaacttccaaacgcctgaaccgcagtggccaggcgttcctccagaacctcctcccacaggagcttgctacacatgccggaaatctggccactgggccaaggaatgcccgcagcccgggattcctcctaagccgcgtcccatctgtgcgggaccccactgaaaatcggactgttcaactcacctggcagccactcccagagcccctggaactctagcccaaggctctctgactgactccttcccagatcttctcggcttagcagctgaagactgacactgcacgatcgcctcggaagccccctagaccattcacggacgccgagcttcgcgtaactctcacagcggaaggtaagcctgtccccttcttaatcaatacggaggctacccactccacgttaccttcttttcaagggcctgtttcctttgccttcataactgttgtgggtgttgacggccaggcttctaaacctcttaaaactccccaactctggtgccaacttagacaatactcttttaagcactcctttttagttatccccacctgcccagttcccttattaggctgagacactttaaattatctgcttccctgactattcctggactacagctatatctcattgccgcccttcttcccaatccaaatcctctttgcatctgtcctcctcttgtatccccccaccttaacccacaagtataagatacctctactccctctttggcgacggatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttacaattcccccattttacctgtcctaaaaccagacaaggcttacaagttagttcaggatctgcaccttatcaaccaaattgttttgcctatccaccctgtggtgcccaaccccatacactcttttgttctcaataccttcctccacaactcactattccgtgcctgatcttaaagatgcttttttcactattcccctgcacccctcgtcccagcctctctttgctttcacttagactgaccctgacacccattaggctcagcaaattacctaggccatactgctgcaaaccttcacagatagaccccattacttcaatcaagcccaaatttcatcctcgtctgttacctatttcagcataattctcataaaaacatacatgctttccctgctgatcatgtccgattaatctcccaaacctcaatcccttacaaaacaacaactcctttccttcctaggcatagttag

SEQ ID NO: 4 - DNA, 455 bp, Homo sapiens
tccaatgttgatgacatcgaaggcacccctcctgaggaaatctcaactgcatgacccctactatgccccaattcagcaggaagcagttagagcggtcattggccaacctccccaacagcacttgggttttcctgttgagaggggggactgagagacaggactagctggatttcctaggccgactaagaatccctaagcctagctgggaaggtgactgcatccacctttaagcatggggcttgcaacttagctcacacccaaccagtgaggtagtaaagagagcttactaaaatgctaattaggctaaaacaggaggtaaagaaatagacaatcatctatcacctgagagcacagtgggagggacaatgatcggcatataaacccaggcattcgagccagcaacagcaaccccctttgggagctctgttttcactctattaaatcttgcaactgca

SEQ ID NO: 5 - DNA, 2837 bp, Homo sapiens
tgggtcaggcaaaaataagcccaccccactaggaactatgttaaaaaaaataaaaatttcaagaaagaatttaagggagattacgatgttactgtgacaccaggaaaacttagaactttgtgtgaaatagactggccagcattagagtgggttggtcatcagaaagaagcctggacaggtcccttgtttcaacggtatgacacagggcaacctgtaagccaaggcacccagaccagtttccatacatagacagttacagctggttttagacccccttcccctccacagtagttaaaagaacagcagcataagcagttgggagaggcaaggaaagaccagcagagaaaaaaaaaaaagaggccatctataccaattctaagttaatttagactaaacaaggtcttattaatagcaaaggataattgaaatcccaaacttacaaggttttcaacaaaagtgaagtttgctaaaagttaacagcataacatatattgtggtaacttctaatcttgtggccttagagagtctagtccaaagacataaagaaagttcgctttaaaaaaaggaatggttatcttcaaaaaaaaaagcgggggggaggcagaatttatgtaaaaagagtgttatatggtaaattcttgtcctgaaataaattaactggttgtttaaagaaaaaaaatgtttgtaataagtcagaaagttgaggcatgttgaagaattgtcggcgaaagttgtgaaagaaaaaatgttataaaaaaatttatgcaaaaaagcctcctgagtactactattgaagaaacagtttatgtgcaaggtgtataaaaatagtaaaatatacctttggtaaaaagattataaggaggcataagaatgtggatttttaccaacattaaaaggttaaaaaattattgttttgaaagtttaagcaagttttaaaactttaattgtaaagaaaattctgtgtataaacatattagctaaagttaaaaaggtatcatccagcttttctgtgaactggacattaaagtaaaaatgcaacaggtttttcttaaagcatcaacctgctctttaacaaaaattataaaaggttaaaaagagtctataaaatctcaccttatggtcaaacatgaaaaattggataaatatatctacaaggttttattaaaattaagtttaacattaataacacactaatataaaggtaaaatttagcttatctggtataaaaatcatacaagaagcattattaaatataaaatggtgtttaactttctttggtctaaaaactaataaaaataggtactaaaggaaacattccttttactagaggatcatagaagttaaagacttaaaacaaactttggaaattaagacagcataccaagatgcaaatgcctggttgaaatggatcaaatattccatctgcacattaaacaaaagcaattgttatgcttgtgcacatggcaggccagaggccctgattgtcccccttccactaaggtggtcctccagtcgaccaggcgtgggctgcatggtagctgttttccaggattctacagcctggagtaataagtcatgccaagctctctctgctatatcctgaagtccctgagggtcagcccccgaaggccatccagcttctgtctcccaacgctaagttcacttcttgtctctcgtggcagggaggagacttagcattccttggagacctgaagggatgcagtgagcttaagaattttcaagagcttatcaatcagtcagcccttgttcatccccgagtggatgtgtggtggtattgtggtggacctttactgggcactctgctgaataactagagtggcacttgtgctttagtccatttggctatcccttttaccctggcacttcatcaaccagaggaagaaaaaaataaaataaaataaaaatcataaagtgagagaagccccttataggtctttcaactctcacatctatttagatgcaattgaagccccgcaaggaataccagatcaatttaaagcttgaaatcaaatagttacaagatttaaatcaatatcttggtagatgacagtcaataaaaatgcagattagataaactacatctattacaaccaacagcaatgagcttttcatgaatttaaaagaaaaaattgtgttggccccagccctgaggctacctgacctgatgaaactctttacactctatgtgtcagaaagagaaaaaatgatagttggagttttaacccagactgtagggccctggccaaggccagtggcctatctctcaaaacaactgatggggtttccaaaggctggcccccatgtgcaagggccctggcagcaatggccctgttagtacaagaagcaaataagctaactcttaggcaaaacctaaagtcctcgtatgctgtggtgattttaataaataccaaaggacaccattagctaatgaatgctagactaactagataccaaagcttgctctgtgaaaatccccgcataaccattgaagtttgcaacaccctaaactccgccaccttgctcccggtatcagagagcccagttaaacataactgtgtagaagtattggactcagtttattctcgtaggcccaaccaccgagaccacccttaaacatcagtagactgggagctgtacgtggatgggagcagctttgccaacccttgcaaagtgactctgaagaagacgacaagccttgttccggtcacacccggaagctgactggttcacgcatggccgaagcatgaggaaactcatcgcgggaataattttccttaaaatttggacttgtacagtaaggacttcaactgacctta

SEQ ID NO: 6 - DNA, 2754 bp, Homo sapiens
tggatcaggtgcaaagtaagcccaccccactgagaactatgttaaagaatttcaagaaaggatttaatggagactatggagtcactatgactccaggaaaacttagagctttgtgtgaaatagactggccagcattagaggtaggttggacatcagaaggaagcctggacaggtcccttgtttcaaaggtatgacacaaagtaacctgtaaaccaaggcaccaagaccagtttccatacatagacagttacagctgtctttagaccccttcccccccaacagtagttaagagaacagcagcataagcagctggcagaggcaaggaaagaccagcagagagaaaaaaaaggccatctataccaattctaagttaatttagactaaacaaggtcttattaatagcaaaggataattgaaatcccaaacttacaaggttttcaacaaaagtgaagtttgctaaaagttaacagtgtaacacatattatggtaaattctaatcttgtggccttagacagtctagtccaaagacatcaaaaaagtttgcttaaaaaaaaagaaatggttatcttcaaaaaaaaaaaaaaaaaaaaaaagaaggggaggcaaaatttacgtaaaaagagtgttatatggtaaattcttgttctgaaataaattggttgtttcaagaaaaaaatgtttgtaataagtcaaaaagttgagacatgttgaagaattgtcagtggaagtcgtgaaaaaaagttataaaaatttatgcaaaaaggttttataatttaaaagtaatttggcctcttgagtactattgaagaaacagtttatgtgcaaagtgtataaaaaagtaaaacatacctttggtaaaaagattataaggaggcataaaaatgtggatttttacctacattaaaaggttaaaaaaattattgttttaaaagtttaagcaagttttaaaacattaattgtaaagaaaagtctgtgtgtaaacatattagctaaagttaaaaagatatcatccagtttttctgcgaactagacataaaagtaaaaatgcaacaggttttttttcttaaagcatcaacctgctctttaacaaaaattataaaaggttaaaaagagtctataaaatcttaccttatggtcaaacatgaaaaattagataaatatgtcttcaaggttttattaaaattaagtttaatattaatagcatactaatataaaggtaaaatttagcttatctggtataaaaatcatacaagaagcattattaaatatgaaatggtgtttagctttctttggtctaaaaactaatacaaattggtgctaaaggaaacattcattttactagaagatcacagaagttaaagacttaaaaaaaactttggcaattaagacagcataccaagatgcaaatgcctggttgaaatagatcaaatattccatctgcacgttaaacaaaagcaattgttatgcttgtgcacatggcaggccagaggccctaattgtcccctttccactacagtggtcctccagttgaccaggcgtaggctgcatggtaactcttttccaggattctacagcctggagtaataagtcatgccaagctctctctgctatatcctgaagtccctgtgggtcagcctccgagggccatccagcttccatctcccaacactaagttcacttcgtgtctctcacagcagggaggagacagcattccttagagacctgaaaggatgcagtgagcttaagaattttcgaaaggttatcaatcagtcagccgttgttcatccccgagcagatgtgtggtggtattgtggtggacctttactaggtactctgctgaataagtagagtggcacttgtgctttagtccatttggctatccctttcatcctggcatttcatcaaccagaggaagaaaagaaaataataagatatcataaagcgagagaagccccttataggtcttccaactctcatatctatttagatgcaattagagccccgcaaggaataccagatcaatttaaagcttgaaatcaaatagctacaggatttaagtcaatattttggtagatgacagtgaataaaaatgtagattagataaactacatctattacaaccaacagcaaagagcttttcatgagttaaaaaaaaaaaaactcatgtcggccccagccctgaggttacctgacctgactctgtgaagtctgtgtgtcagaaaagaaaaaaatggcagttggagttttaactcagactgtggggcactggccaaggccagtggcctatctctcaaaacaaaaagacagggtttccaaaggctggcccccatgtccaagggccctggcagcaatggccctgttaccacaagaagcagataagctaactcttagacaaaacctaaacataaagtctccccatgctgtggtgattttaataaatactaaaggacaccattagctaataaatgttacactaagtagataccaaagcttgctctgtgaaaatccccacataaccattgaagtttgcaacaccctaaccctgccaccttactcctggtatcagagagcctagttaaacataactgtttagaggtgctggactcagtttattctagtaggcccaacctccgagacaatccttaaccatcagtagactaggagttgtatgtagataggagcagcgtcaccaacccctgcaaagtgactctgaagaagactacaagccctgctccagtcacacccagaagctga

SEQ ID NO: 7 - DNA, 302 bp, Homo sapiens
cgggtcaggtacaaactaagcccaccccactaggaactatgttgaaaaatttcaagaaagaatttaagggagattacggtgttactatgataccaggaaaacttagaactttgtgtgaaatagactggccagcatttgaggtgggttggccatcagaaggaagcctagacaggtcccttgtttcagaggtatggcacaaggtaacctgtaagccaaggcacgcagaccagtttccgtacatagacagttacagctggttttagacccccttccccccaacagtagttaagagaacagcagca

SEQ ID NO: 8 - DNA, 42 bp, Homo sapiens
agaagacaacaagccctactctagtcacacacaggaatctga

SEQ ID NO: 9 - DNA, 1939 bp, Homo sapiens
tgggtcaggcgcaaagtaagcccaccccactgggaactatgttaaaaaaaaatttcaagatttaagggagattacggtgttactatgacaccagaaaaacttagaactttgtgtgaaatagactggctagcattagaggtgggttggctatcagaagaaagcctggagaggtcccttgtttcaaaggtatggcacaaggtaacctgtaagccaaagcacccggaccagtttctatacatagacagttacagctggttttagacccccttccccctctccccacagtagttaagagaacagcagcataagcagctggcagaggcaaggaaagaccagcagagagaaaaaaaggccatctataccaattttaagttaatttagactgaacaaggtcttattaatagcaaaggataattgaaatcacaaacttataaggttttcaacaaaagtgaagtttgctaaaagttaacagtgtaacatgtattatggtaacttctaatcttgtggccttagacagtctagtcaaaacacataaagaaagtttgctttaaaaaaacaatggttatcttcaaaaataaaggggagaggcagaatttatataaaaagagttatatgataaattcttgtcctgaaataaattaactggttgtttaaagaaaagaatgtttgtaataagtcaaaaagttaaaacatgtttaaaaaattgtctgcaaaagtcataaaagaaaaaattttattaaaaaaattttaagcaaaaaatgttgtataatttaaaagtaataaggcctcctgtgtactattaagacagatgcaaattcctggttgaaatggatcaaatattccatctgcacattaaacaaaagcaattgttatgcttgtgcacatggcaggccagaggccctgattgtcccccttccactaaggtggtcctctagtcgaccaggcgtggactgcatggtagctcttttccaggattctacagcctggagtaataagtcatgccaagctctctctgctatatcccaaagtctctgcgggtcagcccccaagggccatgcagcttctgtctcccaacactaagttcacttcgtgtctctcacggcagagaggaaacttagtattccttggagacctgaagggatgcagtgagcttaagaattttcaagagcttatcaatcagtcagcccttgttcatccccgagtggatgtgtggtggtattgtggtggacctttactgggcactctgccaaataactagtgtggcacttgtgctttagtccatttggctatccctttcaccctggcatttcatcaaccaaaaaaaaaaagaaaaaagaaaaactcatgtcggccccagccctgaggctacctgacctgacaaaactctttacactctgtgtcagaaagagaaaaaatggcagttggagttttaacccagaatgtagggccctgaccaaggccagtggcctatctctcaaaacaactagacggggtttccaaaggctggcccccatgtccaagggtcctggcagcaagggccctgttagcacaagaagcaaataagctaactcttagacaaaacctaaacataaagtccccccatgctatggtgattttaataaataacaaaggaaaccattagctaatgaatgctagactaactagataccaaagcttgctctgtgaaaatccccgcataaccactgaagtttgcaacaccctaaaccctgccaccttgctccccgtatcagagagcccagttaaacataactgtgtagaagtactggactcagtttattctagtaggcccaaccactgagaccacgcttaaacatcagtagactaggagctgtacgtggataggagaagcttcgccaacccctgcaaagtgactctgaagaagatgacaagccctgctccagtcacacccggaagctga

SEQ ID NO: 10 - DNA, 5694 bp, Homo sapiens
gtcaggcctctgagcccaagccaagccattgcatcccctatgacttgcacatatacatccagatggcctgaagtaactgaagatccacaaaagaagtaaaaatagccttaactgatgacattccaccatcgtgatttttttctgccccaccctaactgatcaatgtactttgtaatctcccccacccttaagaaggttctttgtaattctccccacccttgagaatgtactttgtgagatccacccctgcccgcaaaacattgctcttaacttcaccgcctatcccaaaacctgtaagaactaatgataatccaccaccctttgctgactctctttttcagactcagcccacctgcacacaagtgaaataaacagccatgttgctcacacaaagcctgtttggtggtctcttcacatggacgcgcataaaatttggtgccatgactcggattggcggacctcccttgggagatcaatcccctgtcctcctgttctttgctccatgaaaaagatccacctatgacctcaggtcctcagacccaccagcccaaggaacatctcaccaattttaaatccggtaagcggcctcttcttactctcttctccaacctctctcactatccctcaaccactttctcctttccactcttcaatctctcccttctcttaatttcaattgctttcattttctggcggagacaaaggagacacgttttatccatggacccaaaactccggcgccagtcacagactaggaaggcagccttcccttggtgtttaatcattgcagggacgcctctctgattatttacccacgtttcagaggtgtcagaccacgcagggacacctgccttggtccttcacccttagcggcaagtcccgcttttctgggggaggggcaagtatccgaaccccttctctccgtgtctctaccccttctctgcgtttctgggggaggggcaagtacccctcaaccccttctccttcatccttagcagcaagtcccgcttttctagggggcaagaacccccaatcccttatttccgcaccctgacctcttatctctgtgccccaatcccttatttccacaccctgacccctttcccgcttttctggagggtaagaacccccgaaccccttccctccatgtctctactctctcttttctctgggcttgcaacttcactatgggcaaccttccaccctccattcctccttcttctcccttagcctgtgttcttaagaacttaaaacctcttcaactcacactgacctaaaacctcaacgccttattttcttctgcaacaccacttggccccaatacaaacttgacaatggctctaaatggccagaaaacggcacttttgatttctccaccctacaagacctaaataatttttgtcgaaaaatggccaaatggtctgaggtgccttacatccaggcatttttcacacttcattccctcccaagtctctgttcccaatgtgattcctcccaaatcctccttctttccctcccgcctgtcccctcagtcccaaccccaagcgtcgctgagtctttccagtcttccttttctacagacccatctgatctttcccctcctccccaggctgctcatcgccaggccgagctaggttccaattctttctcagcttccgttcctccaccctataatccttttatcacctcccctcctcacacccgatctggctcacagtttcgttccgtgactggccctcccccacctgcccagcaatttactcttaaaaaggtggctggagctaaaggcatagtcaaggttaatgctcctttttctttatcccaaatcagatagcgtttaggctctttttcgtcaaatataaaaacccagcccagttcatgactcgtttggcagcaaccctgagacactttacagccctagaccctaaaaagtcaaaaggccgtcttattctcaatactcattttttacccaatctgctcccgacattaaataaaactccaaaaattaaattccggccctcaaaccccacaacaggacttaattaacctcgccttcaaggtgtacaataatagagtagaggcagccaagtagcaacatatttctgagttgcaattccttgcctccactgtgagacaaaccccagccacatctccagcacacaagatcttccaaacgcctaaaccgcagtggccaggcgttcctctagaacctcctcccccaggagtttgctacaagtgccagaaatctggccactgagccaaggaatgcccacagcccaggattcctcctaagccgcgtcccatctgtgtgggaccccactgaaaatcggactgttcaactcacctgacagccactcccagagctcctggaactctggcccaaggctctctgactgactccttcccagatcttctcagcttaacagctgaagactgacactgcccgatcgcctcggaagccctgtagaccatcacggacgccgagctttaggtaactctcacagtggaggataagtccgtcctcttcttaatatggaggctacccactccacattaccttatttttaagggcctgtttcccttgcctccatagctgttgtgcgtattgacagccaggcttctaaacctcttaaaactccccaactctagtgacaacttagacaatactcctttatgcaatcccttttagttatccccacctgcccagttcccttattaggccgagacactttaactaaattatctgcttccctgactattcctggattacagctacatctcattgccacccttctttccaatccaaagcctcctttgcatcctcctcttgtatccccccaccttaacccacaagtataagatacctctactccctccttggtgaccgatcatgcaccccttaccatctcattaaaacctaatcacccttaccccactaaacgccaatatcccatcccacagcatgctttgaaaggattaaagcctgttatcactcgcctgctacagcatggcctttaaaagcctataaactctccttacaattcccccattttacctgtcctaaaaccagacaagccttacaagttagttcaggatctatgccttatcaaccaaattgttttgcctatccaccctgtggtgccaaacccatttactctcctatcctcaatacctccctccacaacccattattctgttctggatctcaaacatgctttctttactattcctttgcacccgtcatcccagcctctcttcgctttcactcggactgaccctgacacccattaggctcagcaaattacctaggctgtactgcctcaaggcttcacagacatcccccattacttcagtcaagcccaaatttcatcctcatctgttacctatctcggcataactctcataaaaatacacatgctctctctgctgatcgtgtctgattaatctccgaaacctcaatcccttacaaaacaacaactcctttccttcctaggcatggttagtgcagtcagaattcttacccaagagccaggaccgccccctgtagcctttctgtccaaacaacttgactttactgttttagcctagccctcatgtctgcgtgcagcggctgccactgctttaatacttttagaggccctaaaaatcacaaactatgctcaactcactctctacatttctcataacttccaaaattattttcttcctcatacctgatgcatatactttctgctcccccgctccttcagctgtactcactctttgttaactcccacaattaccattgttcctggcccggacctcaatctggcctcccacattattcctgataccacacctgacccccatgactgtatctctccgatccacctgacattcaccccatttccccatatttccttttttcctgttcctcaccctgatcatgcttgatttattgatggcagttccaccaggcctaatcgccacacaccagcaaaggcaggctatgctatagtacaagccactagcccgcctcttagaacctctcatttcctttccatcgtggaaatctatcctcaaagaaataacttctcagtgttccatctgctattctactactcctcagggattattcaggccccctcccttccctacacatcaaacttgaagatttgcccccacccaggactggcaaattagctttactcaacatgcccgagtcagataactaaaaaacctcttagtctaagtagacactttcactagataagtagaggcctttcctacagggtctgagaaggccaccgcagtcatttcttcccttctgtcagacacaattcctcaggttagccttcccacctctatacagtctgataacagaccagcctttattagtcaaatcagccaagcattttttcaggctcttagtattcagtgaaacctttatatcccttacggtcctccgtcttcaagaaaagtagaacagactaatggtcttttaaaaacacacctcaccaagctcagccaccaacttacaaaggactggacaatacttttaccactttcccttctcagaagtcagacctgtcctcagaatgctacaaggtacagcccattgaagctcctgtgtagacgctcctttttattaggccccagtcttattccagacaccagaccaacttagactgtgcccccccccaaaaaaaaacttgtcatccctactatcttctttctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgccctaggttctcccaattcttagaccttttatacctgtttttctccttctcttattccatttagtttttcaattcatacaaaaccgtatccaggccatcaccaatcattctatacaacaaatgtttcttctaacatccccacaatatcaccccttaccacaagatctcccttcagcttaatctctcccattctaggttcccacgccgcccctaatcccgcttgaagcagccctgagaaacatcgcccattctctctccataccaccccacaaaaattttcgccgccccaacactttaccactattttgttttatttttcttattaatataagaagacaggaatgtcaggcctctgagcccaagccatgccatcgcatcccctatgacttgcacgtatacatccagatgggctgaagtaactgaagatccacaaaagaagtaaaaatagccttaactgatgacattccaccattgtgatttgtttatgccccaccctaactgatcaatgtactttgtaatctcccccacccttaagaaggttctttgtaattctccccacccttgagaatgtactttgtgagatccacccctgcccgcaaaacattgctcttaacttcaccacctatcccaaaacctataagaactaatgataatccaccacactttgctgactctctttttcggactcagcctgcctgcacccaggtgaaataaacagccacgttgctcacacaaagcctgtttggtggtctcttcacatagacacgcatgaaa

SEQ ID NO: 11 - DNA, 2508 bp, Homo sapiens
cgccaggatgtttaatgctgcaatccaaaattggttggtagcagtacctactgtcagtaccaccagtagacttacttatcacatggtaaacagaatgtcacacaggccacaggtaaattatttacaggactttccttatcaaagatcattaaaatttaggcctaaaggaaaaccttgccccacggaaattcccaaaggatcaaaagacacagaagttttagtttgggaagaatgtgtggccaatagtgcggtgatattacaaaatgatgaattcagaactattacagattgggcaccttgaggtcaatgctaccacaattgcacaggacaaactcaattgtgtcccagtgcacaagtgagtccagctgttaatagtgacttaacagaaagtttagacaaacagaagcacataaaattacagtctttctacccttgggaatggggagaaaaaggaatctctactccaagaccagaaatattaagtcctgtttctggtcctgaacatccagaattatggaggcttactgtggcctcatactgcattagaatttggtctggaaatcaaactacagaaacaagagatcgtaagccattttatactatcgacctaaattccagtctaacagttcctttgcaaagttgtgtaaagccctcttatatgctagtgttaggaaatatagttattaaaccagactcccaaactataacctgcgaaaactgcagattgtttacttgcattgattcgacttttaattggcaacaccatattctgctagtgagagcaagagaaggcgtgtggatccctgtgtccatggaccgactgtgggaggcctcaccatccatccatattttgactgaagtactaaaagccatcttaaatagagccaaaaaattcaattttactttaattgcagtgactatgggattaattgcagtcacagctacggccgctgtggcaggagttgcattgtactcttctgttcagacagtaaactttgttaaccattggcacaataattctacaagattgtggaattcacaatctggtattgataaaaaattggcaaatcaaattaatgatcttagacaaactgtcatttggatggaagataggctcatgagcttagaacatcgtttccagttacagtgtgactggaatacgtcggacttttgtattacaccccgagtttataatgagtctgagcatcactgggacatggttagacgccacccacagggaagagaagataatctcactttagacatttccaaattaaaagagcaaatgttcaaagcatcaaaagcccatttaaatttggtaccaggaactgaggcaatcagcagttcctgatggtctcacaaatcttaaccctgtcacttgggttaagaccatcggaagtactattattgtaaatttcatattaatccttgcatgcctgttctgtctgttgctagtctgcaggtgtacccagcagctccgaagagacagcgaccgtcaagaacgagccatgatgatgatggcagttttgtcaaaaagaaaagggttatgtggggaaaagagagatcagactgttactgtgtctatgtagaaagaagtagacataagagactccattttgttctgtactaagaaatattcttctgccttgagatgctgttaatctgtaaccctagccccaaccctgtgtcgcagagacatgtgctgtgttgactcaaggtttaatggatttatggctatacaggatgtactttgttaaaaaaaagtgcttgaaggcagtatgcttgttaaaagtcatcaccattctctaatctcaactacccagggacacaatacactgcggaaagccacagggacctctgcctagcaaagccagatattgtccagggtttctccccatgtgatagcctgagatatggcctcgtgggaagggaaagacctgaccgtcccccagcctgacacccgtaaagggtctgtgctgaggaggattagtaaaagaggaaggcctctttgcagttgtaataagaggaaggcatctgtctcctgctcatccctgggcaatggaatgtctcgggtgtaaaacccgattgtatgttctatttactgagataggagaaaacagccttagggctagagctgagatgtgctagtggcaatactgctctttaatgcaccaagatgtttgtatacgtgcacatcaaggcacagcaccttttcttaaccttgtttatgacacagagacctttgctcacgttttcctgctgaccctctccccactattaccctattgtcctgccacatccccctctccgagatggcagagataatgatcaataaatactgagggaactcagagaccagtgccagagtgggtcctccgtacgctgagcgccggtcccctgggcccacttttcttctatactttgtctctgtgtctctttcttttctctgtctctcgtcccacctgacgagaaacacccacaggtgtggaggggcaggccaccccttca

SEQ ID NO: 12 - DNA, 2736 bp, Homo sapiens
tgggtcaggcacaaataagcccaccccactaggaactatgttaaaaaaaattttttttcaagaaagaatttaagggagattacgatgttactgtgacaccaggaaaacttagaacttgtgaaatagactggccagcattagaggtgggttggccatcagaaggaagcctggacaggtcccttgtttcaaaggtatgacacaaagtaacctgtaagccaaggcatccagaccagtttctgtacatagacagttacagctggttttagacccccttccccctacagtagttaagagaacagtagcataagcatctggcagaggcaaggaaagaccagcagagagaaaaaaaggccatctataccaattctaagttaatttagactaaacaaggtcttattaatagcaaaggataattgaaatcccaaacttacaaggttttcaacaaaagtgaagtttgctaaaaattaacagtataacatgtattatggtaacttctaatcttgtggccttagacagtctagtccaaagacaaaaaaaaagttcactttaaaaaaaaaaagcgggggaggcagaatttatgtaaaaagagtgttatatggtaaattcttgtcctgaaataaattaactggttgtttaaagaaaaaaaaatgtttgtaataagtcagaaagttgagacatgttgaagaattgtcggcgaaagtcgtgaaagaaaaaatgttataaaaaaatttatgcaaaaaatattgtgtaatttaaaagtaataaggcctcctgagtactatttaaaaaaaaaaacagtttatgtgcaaggtgtataagaaaagtaaaatatacctttggtaaaaagattataaggaggcataagaatgtggatttttacctacattaaaaggttaaaaaaattattgttttgaaagtgtaagcaaattttaaaatgttaattgtaaagaaaattctgtgtgtaaacatattagctaaagttaaaaaggtatcatccagtttttctgtgaactggacattaaagtaaaaatgtgacaggtttttcttaaagcatcaacctgctctttaacaaaaattataaaaggttaaaaagagtctataaaaccttaccttatggtcaaacatgaaaaattggataaatatgtctacaaagttttattaaaattaagtttaacattaataacacactaatataaaggtaaaatttagcttacctggtataaaaatcatacaagaagcattattaaatataaaatggtgtttagctttctttggtctaaaaactaataaaaatagatgctaaaggaaacattcattttactagaggatcatagaagttaaagacttaaaacaaactttggcagttaagacagcataccaagatgcaaatgcctggttggaatggattaaatattccatctgcacgttaaacaaaatcaattgttatgcttgtgcacatggcaggccagaggccctgattgtccctcttccactaaggtggtcctccagtcgaccaggtgtgggctgcatggtagctcttttccaggattctacagcctggagtaataagtcatgccaagctctctctgctatatcccgaagtctctgtgggtcagcccccgagggccatccagcttccatctcccaacactaagttcacttcttgtctctcacggcagggaggagatttagcattccttggagacctgaagggatgcagtgagcttaagagtttccaagagcttatcaatcagtcagcccttgttcatccccgagaggatgtgtggtggtatcggggtggacctttactgggcactctgctgaataactagagtggcacttgtgctttagtccatttggctatccctttcaccctggcatttcatcaaccagaggaaaaaaaaagtaagacatcataaaacgagagaagccccttataggtctttcaattctcacatctacttaaatgcaattggagccccacaaggaataccagatcaatttaaagcttgaaatcaaatagttacaggatttaagtcaatattttagtagatgacagtcaacaaaaatgtagattagataaactacatctattacaaccaacagcaaagagcttttcattagttaaaaagaaaaactcatgtcggccccagccctgaggctacctgacctgacaaaactctttacactctgtgtgtcagaaagagaaaaaatgacagttggagttttaacccagactgtagggccctggtcaaggccaggggcctatctctcaaaacaactagacggggtttccaaaggctggcccccatgtccaagggccctggcagcaactgccctgttagcacaagaagcagatgagctaactcttaggcaaaacctaaacagaaagtctccccatgctgtggtgactttaataaataccaaaggacatcattagctaataaatgctagactaactagataccaaaccttgctctgtgaaaatccccacaaaaccattgaagtttccaacaccctaacccagccaccttactcctggtaacagagagcccagttaaacataactgtttagaggtgctggactcagtttattctagtaggcctaacctccgagaccacccttaaacatcagtagactgggagctgtacgtggatgggagcggctttgccaacccctgcaaagtgactctgaagaaggagacaagccctgctccagtcacacccagaagctga

SEQ ID NO: 13 - DNA, 2689 bp, Homo sapiens
gggtcaggcacaaagtaagcccaccccactgggaactatgttaaaaaaaaaaaaattcaagaaagaattgaggaagcctggacaggtcccttgtttcaaaggtatggcacaaggtaacctgtaagccaaagcacccagaccagtttccgtacacagacagtaacagctggttttagaccccctttcctccccacagtagttaaaagaacagcagtataagcagctggcagaggcagcagagagaaaaggaaagaccagcagagagaaaaaaaggccatctaaaccaattgtaagttaatttagactaaacaaggtcttattaatagcaaaggataattgaaatcccaaacttacaaggttttcaacaaaagtgaagtttgctaaaagttaacagtgtaacatgtattatggtaacttctaatcttgtggccttagtcccaaagacataaagaaagtttgctttaaaaaaaggaatggttatcttcaaaaaaaaaaaaaaaagggggggggggcaggcagaatttaggtaaaaagagtgttatatggtaaattcttgtcctgaaataaattaactggttgtttaaagaaaaaaaaaatgtttgtaataagtcagaaagttgagacatgttgaaaaattgtcggcgaaagtcatgaaagaaaaaatgttataaaaattgtatgcaaaaaatgttgtataatttaaaagtaataaggcctcctgagtaccattaaaaaaaacagtttatgtgcgaagtgtataagaaaagtaaaatatacctttggtaaaaagattataaaggggcataataatgtagatttttacctacattaaaaggttaaaaaaattattgttttaaaagtttaagcaagctttaaaatgttaattataaagaaaattctgtgtgtaaacatattagctaaagttaaaaagatatcatccagtttttctgtgaactggacattaaagtaaaaatgcaacaagtttttcttaaagcatcaacctgctctttaacaaaaattataaaagattaaagagtctataaaatcttaccttatggtcaaacatgaaaaattggataaatatgtctacaaggctttattaaaattaagtttaacattaataacacactaatataaaggtaaaatttaacttatctggcataaaaatcacacaagaagcattattaaatataaaatggtgtttagctttctttggtctaaaaactaataaaaataggtgctaaaggaaacattcattttactagaggatcaagaaagttaaagacttaaaacaaacttcggcagttaagacagcataccaagatacaaatgcctggatgaaatggatcaaatattccatccgcacgttaaacaaagcaactgttatgcttgtgcacatggcaggttggcaggttagagaccctgattgtcccccttccactaaggtggtccttcagtcgaccaggcgtgggctgtatggtagctgttttccaggattctacagcctggagtaataagtcatgccaagctctctctgctgtatcctgaagtccctgcaggtcatccccgagggccatccagcttccgtctcccaacactaagttcacttcttgtctctcatggcaggggaggagacttagcattccttggagacctgaagggatgcagtgatcttaggaattttcaagagcttatcaatcagtcagcccttgttcatccccgagtggatttgtggtggtattgtggtggacttttactgggcactctgccaaataactagagtggcacttgtgctttagtccatttggctatccatttcaccctggcatttcatcagccagaggaaaaaaaataataataagacatcgtaaagcaagagaagccccttataggtctttcaactctcacatctatttagatgcaattggagccccacaaggaataccagatcaatttaaagcttgaaatcaaatagttgtaagatttaagtcaatattttggtagatgacagtcaataaaaatgtaaattagataaactacatctattacaaccaacagcaacgagcttttcgtaagttaaaaagaaaaacgcatgtcggccccagccctgaggctacctgacctgacaaaactctttacactctatgtgtcagaaagagaaaaaatggcagttggagttttaacccagactgtagggccctggccaaggccagtggcctatctctcaaaacaactagaaggggtttccaaagactggcccccatgtccaagggccctggtagcaacagacctgttagcacaagaaacagataagctaactcttgggcaaaacctaaacataaagtgtccccatgctgtggtgattttaataaataccaaaggacaccattagccaatgaatgttagactaactagataccaaagcttgctctgcaaaaatccccacataaccattgaagtttgcaacaccctaaccccaccaccttactcctggtatcagggagcccagtgaaacattaactgtgtagaggtgttagactctgtttattctagtaggcccaacctctgagaccacccttacacatcagtagactgggagctgtacgtggatgggagcagcttcgccagcccctgcaaagtgactctaaagaagatgacaagccctgctccagtcacacccggaagctga

SEQ ID NO: 14 - DNA, 753 bp, Homo sapiens
gagagacaggactagctggatttcctaggccgactaagaattcctaagcctagctgggaaaggtgactgtacctacctttaaacatgcggcttgtaactgaggtcactcccaaccaatcaggtagtaaagaggcctcactaaaatacaaattaggccaaagcaggaggtaaagaaatagttaaatcatatatcacctgagagcacagggggagggacaatgatcaggatataaatccaggcattcgagcagggagtggcaaccccctttgggacccctcacattgtatgggagctctgttttcactgttaaatcttgcaactgcacactctcctggcccatgtttgttactgctcaagctgagcttttgctcacagtccacaactgctgttcaccaccactgctgttcgccaccatcccagacccaccattgacttctggcagggtgtccgctgtgtttctgatcaagtgaggtgcccgttgctgctcccaatcgggctaaaggctcgccattgttcctgcatggctaagtcccgggttcgtcctaattgagctgaacactagtcactgggtgccacagttctcttccatgacccacggcttctaatagagctacaacactcactgtatggcccaagtccttggaatctgtgaggccaaggaccccaggtcagagaacaaaaggcttgctgccatcttgggagcagccccaccccatcttgggagctctaagaacaaagacccgcccataaca

SEQ ID NO: 15 - DNA, 6026 bp, Homo sapiens
gtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccaccttaactgagtgattaaccctgtgaatttccttctcctggctcagcagctcccccactgagcaccttgtgacccccgcccctgcccaccagagaacaaccccctttgactgtaattttccattaccttcccaaatcctataaaacggccccaccccatctcccttcgctgactctcttttcggactcagcccgcctgcccccaggtgaaataaacagccatgttgctcacacaaagcctgtttggtgtctcttcacatggactcgagtgaactttgatgccgtggctcggatcgggggacctcccttaggagatcaatcccccgtcctcctgctctttgctccatgagaaagatccacctacgaccttaggtcctcagaccaaccagcccaagaaacatctcaccaattttaaatccagtaagccgcctctttttactctcttctccaacctccctcactatccctcaacctctttctcctttcaatcttggcgccacacttcaatctctcccttctcttagtttcaattcctttcattttctggtagagacaaaggagacacgttttatctgtggacccaaaactccagcgctggtcacggactgggaaggcagccttcccttgctgtttaatcattgcagggacacctctctgattattcacccacgtttcaagggtgtcagaccatgcagggatgcctgccttggtccttcacccttagcggcaagtcccgcttttctggggaaggggaaagtaccccaaccccttctctctgtgtctctacccgttctctgcttttctggggaaggggcaagtaccccaaccccttctctctgtgtctctaccccttccctgcttttctggggaaggggcaagtaccccaaccccttctcttcttgtctctaccccttctctgattttctggggcaggggcaagaacccctcaaccccttctccttcacccttagtggcaagtcccacttttctgggggaggggaaagtacccctcaaccccttctccttcacccttagtggcaagtcccgcttttctagggggcaagaacccccaatcccttatttccacaccccgacctcttatttctgtgacccaatcccttatttccacaccccaacctcttatctctgtgccccaatcccttatttccatgccccaaccccccttcccacttttctagggggcaagaacccccaatcccttatttccacaccctgacctcttatctctgtgccccaatcccttatttctgtgccccaaccctttctctgcttttctggagggcaagaaacccccaccccttctccgtgtctctactcttttctctgggcttgcctccttcactatgggcaagcttccaccttccattcctccttcttctcccttagcctgtattcttaagaacttaaaacctcttcaactctcacctgacctaaaatctaagtgtctcattttcttctgcaatgcctcttgaccccaatacaaactctacagtagttccaaatagccggaaaacggcactttcaatttttccatcctacaagatctaaataattcttgtcataaaatgggcaaatggtctgaggtgcctgacatccaggcattcttttacacatcagtcccttcctagtctctgtgcccagtgcaactcattctgaatcttccttctttccctcccgcctgtcccctcagtcccaaccccaagcgtcactgagtctttctaatcttccttttctacagacccatctgacctctcccctccttgccaggccaagctaggtcccaattcttcctcagcctccgctcctccaccctgtaatctttttatcgcctcccctcctcacacctggtctggcttacagtttcgttctgtgactagccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatgtctcgttcggcagcaaccctgagatgctttacagccctagaccctaaaaggtcaaaaggccatcttattctcaatacacattttattacccaatctgctcccgacattaaataaaactccaaaaattagaatctggccctcaaaccccacaacaggacttaattaacctcaccttcaaggtgtacaataataaaaaaaaggaagttgcaattccttgcctccactgtgagacaaaccccagccacatctccagcacacaacaacttccaaatgcctgaaccgcagtggccagacattcctccagaacctcctcccccaggagcttgctgcaagtgccagaaatctgaccaccagggcaaggaatgcctgcagcccagggattcctcctaagccatgtcccatctgtgcgggaccccactggaaatcggactgttcaactcacctggcagccactcccagcgcccctggaactctggcccaaggctctctgactgactccttcttggcttagtggctgaagactgacgctgcctgatcgcctcagaagccctgtagaccaccatggacaccgagctttaggtaactctcacagtggagggtaagtctgtccccttcttaatcaatatggaggctacccactccacattaccttcttttcaagggcctgtttcccttgcctccataactgttgtgggtattgacagccaggcttctaaacctcttaaaactccccaactctggtgccaacttgaacaacactcttttatgcactcttttttagttatctccacctgcccagttcccttatcaggccgagatattttaaccaaattatctgcttccctgactattcctggactacagctgcatctcattgctgcccttcttcccaatccaaagcctcctttgcgtcctcctcttgtattcccccaccttaacccacaagtataagatacctctactccctccttggcgaccgatcatgcaccccttaccatctcattaaaacctaatcacgcttacccgactcaatgccaatatcccatcccacagcatgctttgaaaggattaaagcctgttatcactcacctgctacagcatggccttttaaagcctataaactctccttacaattcccccgttttacctgtcctaaaaccagacaaggcttacaacttagttcagaatctgtgccttatcaaccaaattgttttgcctatccaccccgtggtgccaaacccatatactctcctatcctcaatacctccctctactacccattattctgttctggatctcaaacatgctttctttactattcctttgcactcttcatctcagcctctctttgccttcacttagactgaccctgacacccattaggctcagcagcttacctgggctgtgctgccgcaaggttccagggacagccctcattacttcagccaagctctttctcatgatctactttctttccacccctccacttctcaccttattcaatatattgatgaccttcttctttgtagcccctcctttgaatcttctcaacaagacatacttctgctccttcagcatttattctccaaaggatatcgggtatccccctccaaagctcaaatttcttctccatccgttacctacctcggcataattcttcacaaaaacacaggtgctctccctgctgatggtgtctgattaatctcccaaacctcaatcccttacaaaacaacaactcctttccttcctaggcatggttagtgcggtcagaattcttacacaagagccaggaccccaccctgtagcctttctgtccaaacaacttgaccttactgttttagcctagccctcatgtctgcatgcagcagctgccgctgctttaataattttagaggccctaaaaatcacaaactatgttcaactcactctctacatttctcataacttccaaaatctattttcttcctcatacctgacgcatatactttctgctccccggctccttcagctgtactcattctttgttaagtcccacaattaccattgttcctggcccagacttcaatctggcctcccacattattcctgataccacacctgatccccatgactgcatctctctgatccacctgacattcaccccatttccccatattacaagccactagcccatctcttagaacctctcatttcctttccattgtagaaatctatcctcaaggaaataacttctcagtgttccatctgctattctatctgctattctgctactcctcaaggatcattcaggcccctcccttccctacacatcaagctcgaggatttgcccccgcccaggactggcaaattagctttactccacatgccccgagtcacaaaaactaaaatacctcttagtctaagtagacattttcactagataggtagaggcctttcctacagggtctgagaaggccaccgcagtcatttcttcccttctgtcagacataattcctcagtttagccttcccacctctatacagtctgataacagaccaggctttattagtcaaattagccaagcagtttttcagtttatatcccttatagtcctctgtcttcaagaaaagtagaacggactaaaggtcttttaaaaacacacctcaccaagctcagccaccaacttaaaaagaactggacaatacttttaccactttcccttctcagaagtcagacctgtcctcagaatgctacaaggtacagtccatttaagctcctttttattaggccccagtctcatcccagacaccagaccaacttagactgtgcccccaaaaaaacttgtcatccctactattttccgtctagtcatactcctattctccgttctcaactactcatacatgccctgctcttgtttacactgccagtttacactgtttctccaagccatcatggctgatatctcctcatgctatccccaaactgccactcttaactcttgaagtaaataaataatcttcgctggaaggactatgctgaacctccttaggcattctctaattagatgtcctagatcctcccaattcttagtccttttatacctgtttttctccttctcttattccatttagtttttcagttcatacaaaaccgtatccaggccatcaccaatctttctgtatgacaaatgtttcttctaacaaccccctcaatgtcaccccttaccacaagacctcccttcagcttaatctctcccactctaggttcccacgccgcccctaatcccgcttgaagcagccctgagaaacatcgcccattctctctccataccaccccccaaaaattttcaccgccccaacacttcaacacaattttgttttatttttcttattaatataagaaggcaggaatgtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaacggccccacccctatctcccttcgctgactctcttttcggactcagcccgcctgcccccaggtgaaataaacagccatgttgctcacacaaagcctgtttggtgtctcttcacacggacgcgcatgaaa

SEQ ID NO: 16 - DNA, 408 bp, Homo sapiens
gtcaggcctctgagcccaagcctgcacgtatacgtccagatggcctgaagcaagtgaagaatcacaaaagaagtgaaaatggctggttcctgccttaactgatgacattccaccattgtgatttgttcctgccccaccttaactgattgattaaccttgtgaaattccttctcctggctcagaacctcccctgctgagcaccttgtgaccccgcccctgcctgtaagagaaaaaccccctttgactgtaattttccactacccacccaaatcctataaaacagccccacccctatctccctttgctgactgtctttacggactcagccagcctgcacccaggtgaaataaacagccttgttgctcacacaaagcctgtttggtggtgtcttcactgggaagcgcgtga

SEQ ID NO: 17 - DNA, 327 bp, Homo sapiens
tgggtcaggcacaaagtaagcccaccccaccaggaactatgttgaaaaatttcaagaaaggatttaagggagattatggtgttactctgacaccaggaaaagttagaactttatgtgaaatagactggccagcattagaggtggatttcccatcagaagtaagccttgacgggtccgttgtttcaaaggtatggcacaaggtaacctgtaagccagggcacgcaaaccagttcctgtacatagacacttggttacagctggttttagatccgcctcacagtggttgagagaacagcagcataagcagctgacagaggcaaggaaaga

SEQ ID NO: 18 - DNA, 410 bp, Homo sapiens
gtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaagcctgtttggtggtcgcttcacacagacacgagtgaaa

SEQ ID NO: 19 - DNA, 2715 bp, Homo sapiens
agtaagcccaccctactaggaactatgttaaaaaatttcaagaaagaatttaaaggagattacggtgttactgtgacaccaggaaaacttagaactttgtgtgaaatagactggccagcattagaggtaggttggccatcagaaggaagcctggacaggtcccttgtttcaaaagtatggcacaaggtaacctgtaagccaaggcacccaggccagtttccgtacatagacagttacagctagttttagacccccttccccccaacagcagttaagagaacagcagcataagtggctggcagaggcaaggaaagaccagcagagagaaaaagaggccatctataccaattctaagttaattcagactaaacaagatcttattaatagcaaaggataattgaaatcccaaacttacaaggttttcaacaaaagtgaagtttgctaaaagttaacagtgtaacatgtattatagtaacttctaatcttgtggccttagacagtctagtccaaagacataaagaaagttcgctttaaaaaagagaagggcgggggggggaggcaaaatttatgtaaaaagagtgttatatagtaaattcttgtcctgaaataaattaactagttgtttaaagaaaaaaatgtaataagtcaaaaagttaagacatgttgaaaaattgtctgcaaaagtcgtgaaagaaaaaatgttataaaaaaatttatgcaaaaaatgttgtataatttaaaagtaataaggcctcctgagtaccattaaagaaacagtttatgtgcaaggtgtataagaaaagtaaaatatacctttagtaaaaaaattataaagggacataaaaatgtggatttttacctacattaaaagttaaaaaaattattgttttaaaaatttaagcaagttttaaaacgttaattgtaaagaaaattctgtgtgtaaacatattagctaaagttaaaaagatatcacccagtttttctgtgaactggacattaaagtaaaaatgcaacaggtttttcttaaagcatcaacctgctctttaacaaaaattataaaaagttaaaaaaagtctataaaatcttaccttatggtcaaacataaaaaattagataaatatgtctacaaggttttattaaaattaagtttaacattaataacacactaatataaaagtaaaatttaacttatctactataaaaatcatacaagaaacattattaaatataaaatagtatttagctttctttagtctaaaaactaataaaaataggtgttaaaggaaacattcattttactaaaggatcatagaagttaaagacttaaaacaaactttggcaattaagacagcataccaagaatgcaaatgcctggttgaaatggatcaaatattccatctgcacattaaacaaaagcaattgttatgattgtgcacatggcaggccagaggccctaattgtcccccttccactaaggtggtcctccagtcgaccaggcgtaggctgcgtggtagctcttttctgagattctacagcctggagtaataaatcatgccaagctctctctgctatatcccaaagtccctgcagatcagcacctgaggtccatccagcttctgtctcccaacactaagttcactttgtgtctctcacagcaaggaggagacttagcattccttggagacctgaagggatgcagtaagcttaagaattttcaagagcttatcaatcagtcagccgttgttcatccccaagcagatgtgtggtggtattgtggtggacctttactgggcactctgctgaataactagagtggcacttgtgctttagtccatttggctatccctttcaccctggcatttcatcaaccagaggaaaaacaaaaaataagacatcgtaaagccagagaagccccttataggtctttcaactctcacatctatttagatgcaattggagccccacaaggaataccagatcaatttaaagcttgaaatcaaatagttacaggatttaagtcaatattttagtagatgacagtcaataaaaatgtagattagataaactacatctattacaaccaacagcaacgagcttttcatgagttaaaaagaaaaactcatgttggccccagccctgaggctacctgacctgacaaaactctttacactctatatgtcagaaagagaaaaaatggcagttgaagttttaacccagactgtaaggccctggccaaggccagtggcctatctctcaaaacaactagacgaggtttccaaatggcccccacgtccaagcgccctggtagcaacggccctgttagcacaagaagcagataagctaactcttaggcaaaacctaaacataaagtcctgccatgctgtggtgattttaataaataccaaaggacaccattagctaatgaatgctagactaactagataccaaatcttgctctgtaaaaatccctacataaccattgaagtttgcaacaccctaaccccgccaccttactcctggtatcagagagcccagtttaacataaactgtgtagaggtgttagactcagtttactctagtaggcccaacctccaagaccacccttaaacatcagtagactaggagctgtacgtggataggagcagcttcacccacccctgcaaagtgactctgaaaaagacgacaagccccgctccagtcacactcagaagctga

SEQ ID NO: 20 - DNA, 5651 bp, Homo sapiens
cttaactgatgacattccactacaaaagaaatgaaaatggcctgttcgtgccttaactgatgacagtatcttgtgaaagtctttctcctgactcatcctggcttaaaagctcctttactgagcaccttgtgacctctactcctgccccccagagaacaacctttctttgactgtaactttttttttacttacctaaatcttataaaatggcctcacttttatctctttttgctgactctcttttcggactcagcctgcctgcacctaggtgaaataaatagctgtattgcttacacaaagcctgtttggtggtcttttcacacggacgtgagtgaaatttggtgccgtgacttggattgggggacctcccttaggagatcaatcctctgtcctcttgctctttgctctgtgaaaaagatccacctacaacctcagatcctcagacccaccagcccaaggaacatctctccaattttaaatccggtaagcggcctcttcttactctcttctccaacctctctcactatcccttaaccactttctcctttcaatcttggtgccacccttcaatctctcctttctcttaatttcaggtcctttccttttctagtagagacaggagatgcgttttatccgtggacccaaaactccggtgctggtcatggactcaggaagacagtcttcccttggtgtttaatcacacaaggacacctgcctgattattcgcccatgtttcagaggtatctgacgacgcggggatgcctaccttcgttcttcacccttagcagcaagtactgcttttctagggggcaagaaccccccaaccccttctctccatgtctctaccccttctctgcttttctggaaggcaagaaccccccaaccccttctccttcatccttagcggcaagtaccacttttctaaggggcaagaagcccccaaccccttctgtccatgtctctacaccttctctgcttttctaggggcaagaacccccgatcccttatttctatgcctgaacctcttatctctacgccccgatcccttatttccgtgccccaaccacttatttccgtgccacgacctcttatctctgtgccctgatcccttatttcctcaccccgacctcttatctctgtgtcccaacccctttttccgtgccccaacctcttatctctgcaccctaaacccttatttccatgccctgaaccctttccccttttctagaaggtaagaacccctgaaccccttccatgtctctacccttctctttaaacttgcctccttcactataggcaagcttccaccctccattcctccttcttctcccttagcctgtgttcttaagaacttaaaacctcttcaactctcgcctgacctaaaatctaagcatcttattttcttctgcaatgctgcttgaccccaatacaaacttgacagtagctccaaacagccagaaaacggcactttcaatttttccatcctacaagatctaaataattcttgtcgtaaaataggcaaacagtctgagttgcccgacgtccaggcattcttttacacatcagtccctcccaaatctctgttcccaatgcaacccgtcccaaatcctccttctttccctccctcctgtcccctcagtcccaaccccaagcgtcgctaagtctttctactcttccttttctacagacccatctgacctctcccctccttgccaggctgagctaggtcccaattcttcctcagcctctgctcctccaccctataatccttttatcacctcccttcctcacaccaggtccggcttacagttttgttccacgactagccctcccccacctgcccagcaatttcctcttaaaaaggtggctgaagctaaaggcataatcaaggttaatgctcctttttctttatccgacctctcccaaatcagttagcttttaggctctttcaacaaatatgaaaaacccagcacagttcatggctcattcggcagcaactctgagacgctttacagccctagaccctaaaaagtcaaaaggccgtcttattctcaatatacattttattacccaatccgctcctgacattaaataaaactccaaaaattaaattccggccctcaaaccccacaacaaggcttaattaacctcaccttcaaggtgtacaataacagagtagaggcaaccaagtagcaatgtatttctaagttgcaattccttacctccactgtaagacaaaccccagccacatctccagcacacaagaactccaaatgcccgaaccgcagctgccagaggttgcaggaccccactgaaaatcagaccgttcaactcacctggcagccactcccagagcccctggaactctggcccaaggctctctgactgaatccttcccagatcttctcggcttagcagctgaagactgacactgcccgatcgcctcagaagcctacgagaccatcacagacacactaggtaactctcatagtggaaagtaagtccacccccttcttagtcaatacgtaggctacccactccacattaccttcttttcaaaggcctatttcccttgcctccataactgttgtaggtattgacggccaggcttctaagcctcttaaaactccccagttctggtgccaacttagacaatactcttttatgcactcttttttttagttatccccacctgcccagttcccttattaggccaagacattttaactaaattatctgcttccctcactattcctggactacagctgcatctcattgctgcccttctccccaacccaaagcctcctttgcgtcttcctctcatatccccccaacttaacccacaagtataggacatctctactccttccctggcaactgatcacatgcctattaccatcccattaaaacctcatcacccttaccctgctcattgccaatatcccatcccacagcacgatttaaaaggaataaagcctgttatcactcacctgctacagcataggcttctaaaacctatacactccccttataattcccctatttcacctgtcctaaaaccagacaaggcttataggttagttcaagatctgcgccttatcaaccaaattgttttgcctatccaccccatggtgccaaacccatatactctcctatcctcaacacctccctccacaatccattattctgttttagatctcaaacatgctttctttattattcatttgcacccttcatcccagcctctctttgctttcacttggactgaccctgacacccatcaggctcagcaaattacctaggctgtattgccgcaagtcttcacagacagcccccattacttcagtcaagaccaaatgtcttcctcatctgttacctatctcggcataattctcataaaaacacatgtgctctccctgctgatcctgtctggctaatctcccaaaccccaatcccttctacaaaacaactcctttcctttctaggcatggttagtaaggtcagagttcttaacaagagccaggaccgcaccctgtaggctttctgcccaaacaacttgacctttctgttttagcctaggcctcatgtctgcgtgcagtggctgccactgctttgacacttttagaggcccttaaaatcacaaactatgctcaactcactctacctttctcataacttccaaaatctattttcttcctcacacctgacgcatatactttctgctctctggctccttcagctgtgctcactctttgttgagtcccacaattaccattgttcttggccgggacttcaatccggcttcccacattattccagataccacacctgaccctcatgagtgcatctctctgatccacctgacattcaccccatttccccatatgtccttcttccctgtttctcaccctgatcacacttggtttattgatggcagttccaactggcctaattgccactcaccagcaaaggcaggctatgctatagtactagccactagcccgcctcttaaaacctctcatttcctttccatcgtggaaatctatcctcaaagaaatcacttctcagtgttccatctgctattctactactcctcaggtattatttaggccccttcccttccctacacatcaagctcgaggatttgcccccacccaggactggcaaattggctttactcaacatgccccaagtcagaaaactaaaatacctcttagtctgggtagacactttcactagatgggtagaggcctttcctacagggtctgacaaggccaccacggtcatttcttcccttctgtcagacataattccttggtttggccttcccacctctatacagtctgataacggaccagcctttattagtcaaatcagccaagcattttttttggctcttggtattcagtgaaacctttatatccttttcagtcctcagtcttcaagaaaggtagaacggactaatggtcttttaaaaacacacctcaccaagctcagccaccaacttaaaaaggaccgcacaaggctttcacaactttcccttctcagaattcaggcctgtccttggaatgctacagggtacaatttgagctcctgtatggatgctcctttttattaagccccagtttcattccagacaccagaccaacttggactgtgccccaaaaaacttgttatccctacggtcttctgtctagtcatactcctattcaccattctcaactactcatacatgccctgctcttgtttactctgccggtttacactgtttctccaagccatcacagctgataactcctggtgctatccccaaactgccactcttaactcttgaagtaaataaataatctttgctggcaggactatgatgaatctccttaagcactctctaattaaatgtcctaagtcctcccaattcttagacctttaacacctgtttttctccttctcttattccatttagtttttcaattcatacaaaactgtatccaggccatcaccaataattctacatgacaaatgtttcttctagcagtcccacaatatcaccccttaccacaaaatcttccttcagcttaatctctcccactctaggttcccacgccgcccctaatcccgcttgaagcagccctgagaaatattgcccattatctctccatgccatccccaaaaattttcgccgtcccgacactttaccaccacttcgttttatttttcttattaatataagaagacaggaatgtcaggcctctgagcccaagctaagccatcatatcccctgtgacctgcacatacacatccagatggccggtacctgccttaactgatgacattccaccacaaaagaaatgaaaatggcctgttcctgccttaactgatgacattatctcgtgaaattccttctcctggctcatcctggctcagaagctcccctactgagcaccttgtgaccccccactcctgcccaccagagaacaacccccctttaactgtaattttcctttacctacccaaatcttataaaacagccccacccctatcgcccttcactgactcttttcggactcagcccgcctgcacccaggtgaaataaagctttattgctcacacaaaacctgtttggtggtctcttcacacagacgcgagtgaaa

SEQ ID NO: 21 - DNA, 3310 bp, Homo sapiens
gtcaggcctctaagcccaagctaagccatcatatcccctgtgacctgcacgtacacatccagatggccagttcctgccttaactgatgacattccaccacaaaagaagtgaaaatggcctgttcctgccttaactgatgatattatcttgagaaattccttctcctggctcatcctggctcaaaagctcccctactgagcaccttgtgacccccactcctgcccgccagagaacccccctttgactgtaattttcctttacctacccaaatcttataaaacggccccaccccatcttccttcgctgactcccttttcggactcagcccgcctgcacccaggtgattaaaagctttattgctcacacaaagcctgtttggtggtctcttcacacggacgcacatgaaatttggtgctgtgactcggatcgggggacctcccttgggagatcaatcccctgtcctcctgctctttgctccgtgaaaaagatccacctatgacctcaggtcctcagacccaccagcccaaggaacatctcaccaattttaaatcaggtaagcagcctctttttactctcttctccaacctccctcactattcctcaacctttctcctctcaatcttgatgccacacttcaatctctgccttctcttaatttcaattcttttcattttctggtagagacaaaggagacacgttttatctatggacctaaaactctggcgccggtcatggactgggaaggcagccttcccttggtgtttaatcattgcagggacgcctgattattcacccacgtttcagaggtgtcagaccacgcagggacgcctgccttggtccttcaccctttgaggcaagtcccactttcctggaggagggacaagaaccccaacctcttatctctgtgccccatcccttttttccgtgccctgaccccttttccacttttctggagggtaagaatcccccaccccttctccgtgtctctactctcctttctctgggcttgcctccttcactatgggcaagcttccaccttccattcctccttcttctcccttagcccgtgttcttaagaacttaaaacctcttcaactcactcctgacctaaaacctaaatgccttattttcttctgcaatgccgcttgaccccaatacaaactcgacagtagttccaaatagccggaaaacggcactttcaatttttccatcctacaagatctaaataattcttgtcgtaaaataggcaaatggtctgaggtgcctgatgtccaggcattcttttacacatcggtccctccctagtctctgttcccaatgtgactcgtcccaaatcttccttctttccctcccacctgtccccagtcccaaccccaagcgtcgctgagtctgtctaatcttccttttctacagacccatctgacctctcccctcaccaggccaagcgaggtctcaattcttcctcagcctccgctcctccaccctataatccttttatcccctcccctcctcacacccagtccagcttatagtttcgttccgtgactagccctccccaacctgcccagcaatttactcttagaaaagtggctggagctaaaggcatagtcaaggttaatgctcctttttctttatcccaaatcagagagcgtttaggctcttcttcatcaaatataaaaacccagcccagttcatggctcgttcggcagcaaccctgagatgctttatagccctagatcctaaaaggtcaaaaggccgtcttattctcaatatacattgtattacccaatctgctcccaacattaaataaagctccaaaaattaaattccggccctcaaaccccacaacaggacttacttaaccttgccttcaaggtgtacaataatagagtagaggcagccaagtagcaacatatttccgagttgcaattccttgcctccactgtgagacaaactccagccacatctccagcacacaagaacttccaaacgcctgaaccgcagtggctaggtgtacatccagaactgcctcccccaggagcttgctacaagtgccagaaatctggccaccaggccaaggaatgcccgcagcccaggattcctcctaagccgtgtcccatctgtgcaggaccccactggaaatcggactgttcaactcacctggcagccactcccagagcccctggaactctggctgaaggctctctgactccttcccagatcttctcggcttagcagctgaagactgacaccgcctgattgcctcagaagcttacaggaccatcacagacgctctaagtaactctcacagtggagagtaagtccgtccccttcttaatacggaggctacccactccacattaccttcttttcaagggcctgtttctcttgcctccataactgttgtaggtattgacagtcaagcttctaaacctcttaaaactcctcaaatctggtgccaacttagacaatactcttttaagcactcctttttagttatccccacctgcccagttcccttattaggccgagacactttaactaaactatctgcttccctgactattcctggactaaggctacatctcattgctgcccttcttcccaatccaaagcctcctttgcgtcctcctcttgtatccccccaccttaacccacaagtataatatacctctactccctccttggtgaccgatcatggaccccttaccatctcattaaaacctaatcacccttaccccgctcaatgccaatatcccatcccacagcatgctttaaaaagattaaagcctgttatcactcgcctgctacagcatggccttttaaagcctataaactctacttacaattcccccatttcacctgtcctcgaaccagacaagccttacaggttagttcaggatctgagccttatcaaccaaattgttttgcctacccatcctgtggtgccaaacccatatactctcctatcctcaatatctccctctactacccattattctgttctggatctcaaacacgctttctttactattcctttgcacccttcatcccagcctctcttcgctttcacttggactgaccctgacactcattaggctcagcaaattacctgggctgtactgccgcaaggcttcacagacaggtcccattacttcagtcaagcccaaatttcatccccatctgttacctatctgggcataattctcataaaaacacacgtgctctccctgctgatcgtatctgactaatctcccaaacctcaatcccttacaaaacaacaactcctttccttcctaggcatgcttag

SEQ ID NO: 22 - DNA, 975 bp, Homo sapiens
gtcagggaaagaaagagagatcagactgttactgtgtctatgtagaaagaagacataagaaactccattttgttttctactaagaaaaattattctgccttgagatgctgttaatctgtaactttagccccaaccctgtgctcacagaaacatgtgctgtgttgactccaggtttaatggatttagggctgtgcaggatgtcctttgttaaaaatgtgtttgcaggcagtatgcttggtaaaagtcatcaccattctctagtttcgagtacccagggacacagtgcactgcagaaggccgcagggacctctgcccaagaaagcctgggtattgtccaaggattctccccactgagacagcctgagctatggcctcatgggaagggaaagacctgaccatcccccagcccggcacccataaagggcctgtgctgaggaggattagtgaaagaggaaggcctctttgcaattgagataagaggaaggcatctgtctcctgctcatccctgggaatggaatgtctcggtgtaaaactcgatcatacattatatttactgagataggagaaaaccgccttatggctggaggtgagacatgctggtggcaatactgctctttaccgcactgagatgcttgtgtaaagtcaaacataaatctggcctactctcacatcaaggcacagctcctttccttaaccttatttatgacacagagacctttgctcacatgtttccctgctgaccctctctccaccattaccctatagtcctgccacatccccctcaccgagatagtagagatagtgatcaataaatactgagggaactcagagaccagtgccagcgctggtccttcgtatgctaagcgctggtcccctgggtccactcttctctctctatactttttctctgtgtcttatttcttttctcagtctctcatcccacctgacgagaaatagccacaagtgtggaggggc

SEQ ID NO: 23 - DNA, 2668 bp, Homo sapiens
tgcggtcagaattcttacacaaggaccaggaccgcaccctgtagcctttttatccaaacaacttgaccttactgttttagcctagccctcaagtctgcgtatggcggctaccactgccctaatacttttagaggcccttaaaatcacaaactatgctcaactcactctctacagttctcataacttccaaaatctattttcttcctcacacctgacacatatactgtctgcttcccggctccttcagctgtactcactctttgttgagtctcccacattattccggataccacacctgaccctcatgactgcctctctctgatccacctgacgttcaccccatttccccacatttctttctttcatgttcctcaccctgaacacacttagcttattgatggcagttccaccaagcctaatctccactcaccagcaaaggcaggctatgctatagtatcttccacatctatcattgaggctaccgctctttccccctccactacctctcagcaagccgaactcattgccttaagtcaagccctcactcctgcaaaaggactaaatgtcaatatttatactgactctaaatatgccttccatatcctgcacctccatgcaagaggtttcctcactacacaaatgtcctctatcattaatgcctctttaataaaaatgcttctcaaagctgctttacttccaaaggaagctagagtcattcactgcaaaggccatcaaagggcatcagatcccatcgctcaggacaatgcttatgctgataagatagctaaaaaagcagctagcattccaacttatatccctcactttcactttttctccttcccctcagtcactcccacctactcccctgctgaaacttccacctatcaatctcttcccacacaaggcaaatagttcttagaccaaggaaaatatctccttccagcctcacaggcccattctattctgtcgtcatttcataacctcttccatgtaggttacaagccgctagcccgtctcttagaacctctcatttcctttccatcctggaaatctatcctcaaggagatcacttctcagtgttccatctgctattctactacccctcagggattgttcaggccccctcccttccctacacatcaagctcaaggatttgtccctgcccaggactggcaagttgactttactcacatgccccgagtcagaaaacgaaagtatctcttagtctaggtagacactttcactggatatgtagaggcctttcctacaaggtctgagaaggccactgcggtcatttcttcctttctgtcagacataattccttggtttagccttcccacctctatacagtccgatagcagaccggcctttattagtcaaatcagccaagcattttttcaggctcttagtattcagtgaaacctttatctcccttacagtcctcagtcttcaggaaaggtaaacggactaaaggtcttttaaaaacacacctcaccaagctcagccaccaacttaaaaaagactagaccatacttttaccactttcccttctcagaattcaggcttgtcctcggaatgctacaaagtacagcccatttaagctcctgtttagacgctcctttttattaggccccagtctcattccagacaccagaccaacttagactgtgccccaaaaaacttgtcatccctactatgttctgtctagtcatactcctattcaccgttctcaactactcatacatgccctgctcttgtttacactggcagtttacactgtttctccaagccatcacagctgatatctcctggtgctatccccaaactgccactcttaactcttaaagtaaataaataatctttgctggcaggactatgctgaatctctttaggcactctctaattaaatgtcctaggtcctcccaattcttagacctttaatacctgtttttctccttctcttattctgtttagttttccaattcatacaaaactgtatccaggccatcaccaataattctaaatgacaaatgtttcttctaacagtcccacaatatcgccccttaccacaaaatcttccttcagcttaatctctcccactctaggtccccacaccacccctaatcccgctcgaagcagcccattatctctccataccatcccccaaaattttcgccatcccaacactttaccactatttcgttttatttttcttattaatataagaagacaggaatgtcaggcctctgagcccaagctaagccatcatatcccagatggccagttcctgccttaactgatgacattccaccacaaaagtgaaaatggcctgttcctgccttaactgatgacattccaccgcaaaagtgaaaacggcctgttcctgccttaactgatgacattatcttgagaaattccttctcctggctcatcctggctcaaaagctcccctactgagcaccttgtgacccccactcctgcccatcagagaacaacccccctttgactgtaattttcctttaactacccaaatcttataaaacggccccacccctatctccctttgctgactcttttcggactcagcccgcctgcactcaggtgattaaaagctttattgctcacacaaagcctgtttggtggtctcttcacacggacactcatgaaa

SEQ ID NO: 24 - DNA, 806 bp, Homo sapiens
gacatgacaaagttggtacatttgcctgtacaggtttaacacaggtttgatcctaggtctatatttagaaaatagtttctagctgtaagcgaatttaaaaccctcattgtaagtgtattactagtaatagaaacttgcttgctgctcccctgtgtattacgcttgctccttcaaatgataaaaggttttgtagctaccatggtttgtcaaaaaacttcagcacaagtgtattacataaaacactatcactctgtctcgcaaagagactcaaagtaaaaataaaagtgagaactccactaattagtgaaattctcaaagagggggataaggaaggagaccactactattcctgctgccctcctccccccaccttgcctagttcacaaaacaggagaaaagagagaaagcaaaaagttggaaagaaacaaaagataaacagccagacaaccttggcaccaccaccgcggccctagaagttaaaaaagtaataataataacaatccctgacctaaactacttgtgttatctgtaaattccagacattgtatgaaaaagcattgcaaaactttctgttctgttagctgatgcatgtagcccccagtcacgttccccatgcttgcccaatttatcatgaccttttcacgtggaccccttagagttgtgtaagcctttaaaaaggccaagaatttctttttcagggagctcagctcttaagatgcaaatctgccgacactcccagccgaataaacctcttccttctttaatctggtgtctgaggagttttgtctgcagctcttcatgctaca

SEQ ID NO: 25 - DNA, 846 bp, Homo sapiens
agcagctcattgagaacgggccaggatgacaatggcggctttgtggaatagagaggggagaaaggtggggaaaagattgagaaatcggatggttgccgtgtctgtgtagaaggaggtagacatgggagacttttcattttgttctgtactaagagaagttcttctgccttgggatcctgttgatctgtgaccttacccccaaccctgtgctctctgaaacatgtgctgtgtcaaactcagggttaaatggattaagggcggtgcaagatgtgctttgttaaacagatgcttgaaggcagcatgctccttaagcgtcatcaccactccctaatctcaagtacccagggacacaaacactgcagaaggccacagggacctctgcctaggaaagccaggtattgtccaaggtttctccccatgtgatagtctgaaatatggcctcttgggaagggaaagacctgaccgtcccccagcccgacacctgtaaagggtctgtgctgaggaggattagtataagaggaaggcatgcctcttgcagttgagacaagagcaaggcaactgtctcctgtccgtccctgggcaatggaatgtctcggtataaaacccgattgtacgttccatctactgagatggggaaaaaccgcctatctcacctatcaccgcctatcaccactccccaatctcaagtacccagggacacaaacgctgcggaaggccgcagggtcctctgcctaggaaaaccagagacctttgttcacttgtttatctgctgaccttccctccactattgtcctatgaccctgccaaatccccctctgtgagaaacacccaagaatgatcaataaa

SEQ ID NO: 26 - DNA, 3556 bp, Homo sapiens
tcaggcctctgagcctaagctaagccatcatatcccctgtgacctgcatgtacacatccagatggccggttcctgccttaactgatgacattccaccacaaaagaagtgaaaatggcctgttcctgccttaactgatgacattatcttgtgaaattccttctcctggctcatcctggctcaaaagctcccctgctgagcaccttgtgacccccattcctgcccgccagagaaaaaccccctttttcctttacctacccaaatcctataaaacggccccacccctatctcccttagctgactctcttttcggactcagctcgcctgtacccaggtgaaataaacagccttgttgctcacacaaagcctatttggtggtctcttcacacagacgcgcatgaaatttggtgccgtgaatcgggtcaggggacctcccttgggagatcaattccctgtcctcctgctctttgctccatgaaaaagatccacctacgacctcgggtcctcagacccaccaacccaaggaacatctcaccaattgtaaatcgggtaagcagcctcttcttactctcttctccaacttctgtcactatccctcaaccactttctcctttcaatcttggctccacccttcaatctctcccttctcttcatttcagttcctttccttttctgatagagacaggagacgcattttatccgtggacccaaaactccggcgccagtcatggactcaggaagacagtcttaccttggtgtttaatcacggggggacgcctgcctgattattcacccacatttcagaggtgtctgaccatgcggggacgcctgccttggtccttcacccttagtggcaagtaccgcttttctgtggggcaagaatcccccaacctcttctctccgtgtctgtaccccttctccacttttctagggggcaagaaccccccaaccccttctccttcacccttagcggcaagtactgcttttctagggggcaagcaccccccaactccttctctccgtgtctctaccccttctctgcttttctgggggcaagaaccccccaatcctttatttccaagtcctgacctcttatctctgtgccctgattccttatttccatgccccgacctcttatctctgcaccccaaccccttatttccatgccccaacccctttcccacttttctagggggcaagaaccacccccccgaccccttctttccatgtctctactctctcttttctctaggcttgcctccttcactaggggcaagattccgccctccattctcccttcttctcccttagcctgtgttcttaaaaacctaaaacctcctcaactcacacctgacctaaagcctaaatgccttattttctcctgcaatgctgcttgaccccaatacaaactcgacagtggttccaaatagccagaaaacagcactttcaatttttccatcctacaagatctaaataattcttgtcgtaaaatgggcaaatggtctgaggtgcctgacgtccaggcattcttttacacattggtccctcgctagtctctgttcccaatgcaactcatcccagatcttccatctttccctcctgcctgtcccctcagtcccaaccctaagtgttgctgagtttttctaatcttccttttctacagacccacctgacctctcccctccttgccaggctgagctaagtcccgaatcttcctcagcctctgctcttccaccctataatccttttatcacctcccctcctcacactccgtccggcttacagtttcgttcctcgactagccctcccccacctgcccagcaatttcctcttaaaaaggtggctggggctaaaggcatagtgaaggttaatgcccctttttctttatcggacctctcccaaatcagttagtgtttagactctttttcatcaaatatgaaaaacccagcccagttcatggctcgtttggcagcaactgagacgctttacggccctagaccctaaaaggtcaaaaggccgtcttattctcaatatacattttattacccaatccgctcctgactttaaataaagctccaaaaattaaattccagccctcaaaccccacaataggacttaattaacctcaccttcaaggtgtacaataatagaaaatgttgcaattccttgcctccactatgagacaaaccccagccacatctcccacacacaagaacttccaaacgcctgaaccgcagcagccaggcattcctccagaacctcctctcccaggagcttgctacaagtgtgggaaatctggccaccgggccaaggaatgcccagagcccgggattcctcctaagccgcctcccatctgtgtaggaccccactgaaaatcggactgttcaactcacctggcagccactcccagagcccctggaactctggcccaaggctctctgactgactccttcccagatcttctcggtttagcagctgaagactgacactgcccgatcgcctcggaagccccctagaccatcatggacaccgagattcaggtaactctcacagtagaaggtaagtccgtccccttcttaatcaatatggaagctacccactccacattaccttcttttcaagggcctgtttcccttgcctccataactgttgtaggtactgacagccaggcttctaaacctcttaaaactccccaactctggtgccaactcagacaatactcttttaagcactcctttttagttatccccacctgcccagttcccttgttaggccaagacactttaactaaattatctgcttccctgactattccagggctacagccacacctcattgccgccttttcccccagttcaaaacctccttaacattctccccttgtatctccccaccttaacctaccaggataagacacctctactccctccttagcgaccgatcatgcaccccttaccatcccatcaaaacctaatcaccctaacctcgctcaatgccaatatcccatcccacagcacactttaaaaggattaaagtctgttatcactcacctgttacagcatggccttttaaagcctataaactctccttacaattcccccattttacctgtcctaaaactagataagacttacaggttagttcaggatctgcgccttatcaaccaaattgtgttgcctatccaccccatggtgccaaacccatatactttcctatcctcaatacctccctccacaatccattcttctgttctggatctcaaacatgctttctttattattcctttacacccttcatcccagcctctcttcgctttcacttggactgaccctgacacccatcaggctcagcaaattacctgggctgtactgccacaaggcttcacagacagcccccattacttcagtcaagcccagatttcttcctcatctgttacctatcttggcataattctcgtaaaaacacatgtgctctccctgctgatcgtgtccgactaatctcccaaacctcaatcccttctacaaaaaaacaactcctttccttcctaggcatagttag

SEQ ID NO: 27 - DNA, 2376 bp, Homo sapiens
acaacttgaccttactgttttaggctggccatcatgtccccgtgcagcagctgccgctgccctaacacttttagaggccctcaaaatcacaaactatgctcaactcactctctatagttctcataacttccaaaatctattttcttcctcacacctgatgcatatactttctgctccccggctccttcagctgtactcactctttgttgagtctcccacagttaccattgttcctggcccggacttcaatccagcctcccacactattccggatacatctgactcccatgactgtatctctctgatccacatgacattcactccctttctccatgtttccttctttcctgttcctcaccctgatcacacttggtttattgatggcagttccaccaggcctaatcgccactcaccagcaaaggcaggctatgctatagtatcttccacatctatcactgaggctaccgctctgcccccctccattacctctcagcaagctgaactcactgccttaacttgagccctcactcttgcaaagggactacccatcaatatttatactgactctaaatatgccttccatatcctgcaccaccatgctgttatataggcagaaagaagtttcctcactatgcaagagtcctccatcaataatgcctctttaataagaactcttctcaaggctgctttacttccaaagaaagccggagtcattcactgcaaaggccatcaaaaggcttcagatcccattgctctggacaacgcctatgctgataagatagctaaaaaagcagctagcgttccaacttctatccctcagggcagttttcctccttctcatctggccactcccacctactccctcgctgaaacttccacccatctcttcccacacaaagcaaatggttcttggaccaaagaaaaatctccttccagtctcacaggcccattctattcgtcatttcataacctcttccatgtaggttgcaagccgctagcccgcctcttagaacccgctagcccacctcttagaacctctcatttcctttccatcgcaaaaatctatcctcaaggaaatcacttttcagtgttccatctgctattctactactcctcaagaatttctcaggccccctcccttccccacacatcaagctcggggatttgccccgcccaggactggcaaattgactttactcacatgcctcgagtcaggaaactaaaatacctcttggtctgggtagacactttcactggatgggtagaggcctttcccacagggtctaagaaggccaccgtggtcatttattcccttctgtcagacatagttcctcggtttggccttctcacctctatacagtccgataacggaccggcctttactagtcaaatcacccaagcagtttctcaggctgttggtattcagtggcacctggtttttcctcaaactgccacccttaagtctctctttaagtggatagaagatcttcagtggcaaggtaccctccaatactttcaccctgatgaagtcctattctttacttttatacttactcttattctcattcccgttcttatgccaccctctacctctccccagctatctctatcacactatcaatctcagttactctctcctagccgtttctaatccttctttaacaaacaattgctggctttgcatttctctttcttccaaaatcacaaaggtctcgacttactgctaaaaaaaaaaaaaaggggactctatatttttaaatgaagagtgctatttttacctaaatcaatctggcctggtatatgacaacattaaaaaaaactcaaagatagagcctaaaagcttgccaaccaagcaagtaattacactaaccccccttggacactctaattagatgtcctgggtcctcccaattcttagtccttttatacctgtttttctccttctcttattcagaccttgtgtcttccatttagtttctcaattcatccaaaaccatatccaggccatcaccaatcattctatacgacaaatgtttcttctaacaacccgacaattatcaccccttaccacaaaatcttccttcagcttcatctctcccacactaggtttccatgttgccccagtcctgctcaaagcagccctgagaaacattgcccattatctctccataccaccccccaaaattttccccaccccaacactttaccactattttatttttcttattaatataagaagacaggaatgtcaggcctctgagcccaagctaagccatcatatccccagtgacctgcacgtatacatccagatggcctgaagcaactgaagatacacaaaagaagtgaaaatagccttaactgataacattccaccat

SEQ ID NO: 28 - DNA, 123 bp, Homo sapiens
tttggagctcggtgtttgagatgttaagtctgctgatgctcctggccgaataaaggccaaataaagccctttctttcctcaactcgatgtctgagggttttgtctgtggctcgtcctgctaca

SEQ ID NO: 29 - DNA, 289 bp, Homo sapiens
tgggtcaggcaaataagcccaccccactaggaactatgttaaaaagagaatttcaagagagaatttaagggagattacggtgttactgtggcaccaggaaaacttaaaactttgtgtgaaatagactggacagcattagaggtgggttggcctggacaggtccgttgtttcaaaggtatgacagaaggccacctgtaagccaaggcacccagaccagtttctgtacatagacagttacagctggttttagacccccttcccccccacagcagtcaagagaatagcagca

SEQ ID NO: 30 - DNA, 6470 bp, Homo sapiens
gtcaggcctctgagcccaagctaagccatctcatccctggggacttgcacatatacgcccagatggcctgaagtaactgaagaatcacaaaagaagtgaaaatgccctgccctgccttaactgatgacattccaccacaaaagaagtgaaaatggccggtccttgccttaagtgatgacattaccttgtaaaagtccttttcctggctcatcctggctcaaaaagctctcctactgagcatcttgcgacccccactcctgcccaccagagaacaacccccctttgactgtaattttcctttacctacccaaatcctataaaacagccccactcctatctcccttcactgactctcttttcagactcagcctgcctgcactcaggtgattaaaagctttattgctcacacaaagcctgtttggtggtctcttaacacggacgcacgtgaaatttggtgtcatgactcagatcaggggacatcccttaggagatcaatcccctgtcctcctgctctttgctctgtgaaaaagatccacctacgacctcgggtcctcagacccaccagcccaagtaacatctcaccaattttaaatcgggtaagtggcctctttttactctcttctccaacctccctcactatccctcaacctctttctcctttcaatcttggcaccacacttcaatctctcccttctcttaatttcaattcctttcattttctggtagagacaaaggagacacgttttatccacggacccaaaactccggtgccagtcacggactgggaaggcagccttcacttggtgtttaatcattgcagggatgcctctctgattattcactgaggtttcagaggtgtcagaccacacagggatgcctgccttggtccttcacccttagctgcaagtcctgcttttctgggggaggggcaagtaccccaaccccttctgtgtctctaccccttctccgcttttctggggcaggggcaagaacccctcaagcccttctccttgaccctgagcagcaagtcccacttttctagggggcaagaacccccaatcccttatttccgtgtcccgacctcttatctctgtgccccaatcccttctttccgcaccctgacctcttatctcttgtgccccaatcccttatttccacgccttgacctcttatctctgtgccccaaccccttatttccatgccccgactcctttcccgctttcctggaagctaagaacccccaaaccccttccctccatgtctctactctctcttttctctgggcttgcctccttcactatgggcaaccttccaccctccattcctccttcttctcccttagcctgtgttctcaagaacttaaaacttcttcaactcacacctgacctaaaacatagatgccttatcttctccaccctccattcctccttcttctcccttagcctgtgttctcaagaacttaaaacctctccagatcacacctgacctaaaacctagatgccttatcttcttctgcaatgccgcttgaccccaatataaactcgacagtggttccaaatagccagaaaacggcactttcaatttttccatcctacaagatctaaataattcttgtcataaaatgggcaaacagtctgaggtgcgtgatgtccaagcattcttttatacattgttccctctctagtctctcttcccagtgcgacttgtcccagatcctccttctttccctcccgcctgtcccctcagtcccaacctcaagcatcgctaagtctttctaatcttccttttctacagacccatctgacctctcccctcctcgccaggccgagccaggtcccaattcttcctcagcctctgctcccccaccctataatccttttatcacctcccctcctcacatccagtccagcttacagtttcattccacgactagccttcccccacctgtccagcaatttcctcctaaaaaggtggctggagctaaaggcatagtcaaggttaatgctcctttttctttatctgacctctcccaaaatcagctggcgtttaggctctttctcatcaaatataaaaacccagcccagttcatggctcttttggcagcaaccctgagacgctttacagccctagaccctgaaaggtcagaaggccatcttattctcaatatgcattttattttattacccaatctgctcctgacatgaaataaagctccaaaaattaaattctggccctcaaaccccacaacgggacttaattaacctcaccgtcaaggtgtacaataatagagtagaggcagccaagtagcaatgtatttctgagttgcaattccttgcctccactgtgagacacaccccagccacatctccagaacacaagaactccaaacacctgaaccgcagctgccagagcctcctcccccaggagcttgctacaagtgccagaaatctggccactgggccaaggaatgcccacagcccgggattcctcctaagccatgtcccatctgtgtgggaccccactgaaaatcggactgttcaactcacccggcagccacttccagagcccctggaactctggcccaaggctctctgactgactccttcccagatcttctcggcttagcagctgaagactgacactgcccgattgcctcagaagcctacaggaccatcacagatgctctagataactctcacagtggagggtaagtccttccccttcttagtcaatacggaggctacccactccacattaccttcttttcaagggcctgtttctcttgcctccataactgttgtgggtattgacagccaggcttctaaacctcttaaaactccccaactcttgtgccaatttagaaaacattcttttatgcactcttttttaattatccccacctgcctacttcccttattaggccaagacattttaactaaattatctgcttccctgactattcctggactacagctgcatctcattgccacccttctccccaacccaaagcctcctttgtgtcttcctctcgtatccccccaccttaacccacaagtatgggacatctctactccttccctggcaactgatcacatgcccattaccatcccattaaaaactaatcacccttaccccactcaacaccaatatcccatcccagcatacgatttaaaaggattaaagcctgttatcactcgcctgctacagcatgggcttctaaaacctataaactccccttacaatctccccatttcacctgtcctgaaaccagacaaggcttacaggttagttgaagatctgtgccttatcaaccaaattgttttgcctatccaccccttggtgccaaacccatatactctcctatcctcaatacctccctccacaatccattattctgttctagatctcaaacatgctttctttactattcctttgcacccttcatcctcatcccatttgcaccctcgctttcacttggactgaccctgacacccatcaggctcagcaaattacctgggctgtactgccgcaagttttcacagacagcccccattacttcagtcaagcccaaatttcttcctcatccgttacctatctcagcataattctcataaaaacacatgtgctctccctgctgattgtgtccagctaatctctcaaaccccagtcccttctacaaaacaacaactcctttccttcctaggcatggttattgccgtcagaattcttacacaagagccaggaccgcaccctgtagcctttctgcccaaacaacttgaccttactgttttagcctagccctcatgtctacttgcagtggctgccactgctttaatacttttagaggccctcaaaatcacaaactgtgctcaactcactctctacagttctcataacttccaaaatctattttcttcctcacacctgacgcatatactttctgctccccagctccttcagctgtactcactgtttgttgagtctcccacaattaccattgttcctggcatgaacttcaatctagcctcccacgttattccggataccacacctgaccctcatgactgcatctctctgatctacctgacgttcaccccatttccccacatttccttcttccctgtttctcaccctgatcacacttggtttattgatggcagttccaccaggcctaatcgccactcaccagcaaaggcaggctatgcaatagtatcttccacatctgctattgaggctaccgccctgcccccctccactacctctcagcaagccgaactagttgccttaactcaggccctcactcttgcaaagggactacgcgtcaatatttatactgactctaaatatgcctttcatattctgcaccaccatgctgttatataggctgaaagaggtttcctcactatgcaagggtcctccatcgttaatgcctctttaataaaaactctgctcaaggccactttacttccaaaggaagctggagttattcactgcaaatgccatcaaaaggcatcagatcccattgctctaggcaacgcttatgctgataaggtggctagacaagcagctagctttccaccttctgtccttcatggccagtttgtctcttcacatcagtcactcccacctactcccccgctgaaacttccaactatcaatctcttcccacgaaaggcaaatggttcttagaccaaggaaaatatctccttccagcctcacaggcccattctattctgtcgtcatttcataacctcttccatgtaggttacaagccgctagcctgtctcttagaacctctcatttcctttccatcctggaaatctatcctcaatgaaatcacttctcagtgttccatttgctattctactaccactcagggattgttcaggcctcctccctttcctacacatcaagctagaggatttgctcctgcccaagactggcaaattgactttactcacatggcccgagtcagaaaactaaaagacctcctagtctaggtaggcactttcactggataggtagaggcctttcctacagggtctgagaaggccaccgctgtcatttcttcccttctgtcagacataattcctcggtttggccttcccaactctgtacagtccgatagtagaccggcctttattagtcaaatcagccaagcgttttttcaggctcttagtatccagtgaaacctttatatcccttatggtcctccatcttcaggaaaagtagaacagactaatagtcttttaaaaatacacctcaccaagctcagccaccaacttaaaagggactagacaatacttttaccactttcccttctcagaattcaggcctgtccttggaatgctacagggtacagcccatttgagctcctgtatagatgctcctttttattaggccccagtctcattccagacaccagaccaacttggactgtgctccaaaaaacttgtcatccctactgtcttctgtctagtcatactcctattcaccgttcttaactactcatacatgccctgcttttgtttacactgccggtttacactgtttctccaagccatcacagctgatattggtgctatccccaaactgccactcttaactcttaaaggaaataaataatctttgctggcaggactatgctgaatctccttaggcactctctaatcagatgtcctaggccctcccaattcttagacctttaatacctgtttttctccttctcttattccgtttagtttttcaattcatacaaaactgtatccaggccatcaccaataattctaaatgacgaatgtttcttctaacagtcccacaatatcaccccttaccacaaaatcttccttcagcttaatctctcccactctaggttcccacgccgcccctaatcccgcttgaagcagccctgagaaacatcgcccattctctctctccataccacccccaaaaattttcgccgccccaacacttcaacactattttgttttatttttcttattaatataagaaggcaggaatgtcaggtctctgagcccaagctaagccatctcatccctggggacttgcacatatacgcccagatggcctgaagtaactgaagaatcacaaaagaagtgaaaatgccctgccccgccttaactgatgacattccaccacaaaagaagtgaaaatggccggtctttgccttaagtgatgacactaccttgtaaaagtccttttcctggctcatcctggctcaaaaactcccctactgagcaccttgcaacccccactcctgcccaccagagtacaacccccctttgactgtaattttcctttacctacccaaatcctataaaacggccccacccctatctcccttcactgactctcttttcagactcagcccacctgcacccaggtgattaaaagctttattgctcgcacaaagcctgtttggtggtctcttaatacgggcgcgcgtgaaa

SEQ ID NO: 31 - DNA, 922 bp, Homo sapiens
gtggggaaaagaaagagagatcagattgttaatgtgtctgtatagaaagtagacataagagactccattttaatctgtaaccctacccccaaccctgtgctccctgagacgtgtgctgtgtcaactcagggttaaatggattaagggcggtgcaaaatgtgctttgttaaacaaatgcttgaaggcagcatgctctataagagtcatcaccactccctaatctcaagtacccagggacacaaaacactgcagaaggctgcagggacccctgcctacgaaagccaggtattgtccaaggtttctccccatgtgacagcctgagatatggcctcgtgggaagggaaagacctgaccgtcccccagcccgacacccataaagggtctgtgctgaggaggattagtaaaagaggaaggaatgcctggttgcagttgagacaagaggaaggcatctgtctcctgctcgtccctgggcaatggaatgtctcggtgtaaaacctgattgtatattccatctactgagataggggaaaaccaccttagggctggaggtgggacatgccggcagcaatactgctctttaaggcattgaggtgtttatgtgtatacatatataaagcacagcacttaattctttaccttgtttatgatgcagagacctttgttcacgtgtttacctgctgaccttctctccactattatcctatgatcctgccacatccccctctccgagaaacacccaataatgatcaataaataataagggaactcagaggctggcgggatcctccgtatgctgaacaccggtcccctgggcccctttttctttctctatactttgtctctgtgtctctttcttttccaagtctcttgttccacctaatgagaaacacccacaggtgtggaggggcaacccaccccttca

SEQ ID NO: 32 - DNA, 6574 bp, Homo sapiens
gtcaggcctctgagcccaagctaagccatcatatcccctgtgacctgcacgtatacatccagatggcctgaagcagctgaagatccacaaaagaagtgaaaatagccaggtgctgccttagctgatgacattccaccactgtgacctgttcctgccccaccctaactgatcaattgacctatgacaatacaccctccctgcccttgtgataatgtactttgtgatattcccctgcccttaagaaggtactttgtgatattcccccgcccttaagaaggtactgtgtgatattcccccgcccctaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtacttgtgatattcccccgcccttaagaaggtactttgtgagatccaccccctgcccacaacaaattgctcctaactccaccgcctatcccaaacctgtaagaactaatgataatcccaccaccctttgctgactctcttttcggactcagcccgcctgcacccaggtgattaaaaagctttattgctcacacaaagcctgtttggtggtctcttcacatggatgtgcgcgacatttggtgccaaaacccgagaatggttctaaatggccagaaaatgacacttttgatttctccatcctacaagatctagataattttgtcgaaaaatgggcaaatggtctgaggtgactgacatcccggcattctttcacacatcggtccctccctagtctctgctcccagtgcgacttgtcccacatctttcttctttctcttctgtctgttccttcagtcccaaccccaagcgtcactaagtcttttgaatcttccttttctacccacccatctgacctctccccttcttcccacactgctcctcctcaggtcgctccctgccaggctgaatcaggctccagcttttcttgagcttccgctcccctaccctacaacccctctatcacctcccctgccacacccagtctggcttacagtttcattccatgacgagccctcccctacctgcccaacaatttcctcttaaagaggtggctggagctaaaggcatagtcaaggttaatgctcctttttctctatcagacctttcccaaatcagttagtgtttaggctcttttccatcaaatataaaaacccagcccagttcatggcccgtttggcaacaacccttagatgctttaccgccctagacccagaggggccagaaagccatcttattctcaatatgcgttttattacccaatctgctcctgatactagaaaaagctccaaaaattagattccagccctcaaaccccacaataggacttaattaacctcgccttcaaggtgtacaataataaaaaagagtcagccaagtggcaacatatttctgagttgcgattacttgcctctgccgtgagagaaaccctagccgtatccccagcacacaagaccttcaaattgcctaaaccgcagaggacaggcgttccttcaggacctcctcccccaggatgttgctccacgtgacggaaatctgaccactgggccaaggaatgccagcagcctgggattcctcctaagctgcgtcccatctctgcgggaccccactggaaattggactgtccaactatcccagcagccactcccagagcccctggaactctggcccaaggctctctgactccttcccagatcttcttggttcagcagctgaagactgatgctgcccgatcgcctcggaagcctcctggaccatcacagatgctttgggtaactcttacagtggagggtaagtctgtccctttcttaatcaatacggaggctacccactccacattaccttcttttcaagggccttttcccttgcctccgtaactgttgtgggtattgacagccaggcttctaaacctcttaaaactccccaactctggtgccaacttggacaatactcttttaagcactccttttcagatattcccacctgcccagcttccttattaggtcgagacattttagccaaattatttgcttccctgactattcctgggctacagccacacctcaataacctcccttcacaacccatcattctgttctggttctcaaatatgcttcctttactattcttttccatccttcatcccagcctctcttcgctttcacttggactgatcctgacacccatcaggctcagcaaattacctgggctgtactgccgcaaggcttcacagacagcccccgttacttcagtcaagccctttctcatgatttactttcattctgtccatctgcttctcaccttattcaatattttcacgaccttctactttatagctgcccccccccaccaaaatcttctcaacaggacaccctcctgttcctctaacatctattctcaaagggatatcacatattcccctccaaagcacaaatttcttcctcatcggttacctatctcggcatgattcttcataaaaacacacgtgttttccctgctgatcatgtccagctaatctcccaaaccccaaccccttctacaaagccacagctcctttccttcctaggcatggttaagtactttcacctttggatacctgattttgccatcctgactaaaccattacataaactcacaaaaggaaacctacctggccccatagatcctagatcctttccccactcctctttccattccttaaaaacagccctagaagctgctcccacactagctctccctaactcatcccaacccttttcattacacacaaccaaagtacaggactgtgcagtcggaattcttacacaagagctgggaccgtgccctatagcctttctatccaaacaactcaacttcacaattctgggctggccctcatgtttgtgccatttaaatacttctagaggccatcaaaaatcacaggctatgctccacttaccctttacagctctcacaaccttcaagcattaatatcctcctcatacctttcacatttattgtctgccccccaactcctccagctctattcactctttgttgaaactccaatagtaactattacccatgggcctgatttcaacccagcttctcatttagcacccaacacaagtcctgaaccacatgactgtatttccctaacacacataggatcttctccctttcctcatatttctaatcttcccattccaaacccggaccacacttggtttattgatggcggttcttctaaacccaatcaattttcaccagctaaagctggatatgctgtcatgtcccacacctctattattgaagctgctgcacttcctccctccaccacttcccaacaagccaaactgattgctttaactcgtgtgctctctctagctaaaggaatgcacattaacatttatactgactccatatatgctttccacatcctccataaccatgctgccatctgggtcaaaagaggcttccttaccacacaaagctcttccactaataatgcctccctaatagaggcccttaaggttgttctcctgccagccaaggctggaatcattcattgtaaaggacaccagaaacctactgatcttattgcaaaaaaaaaataaccaatgcctccacacccgctaatattccagcccccactccggagggccagtatttttttttctcctctatcactcccacctactcttcttctgaaaacctgctctaccagtcttttccaactcagggcaagtggttcttagatcatggaaaactcatccttcctgcctcacaagctcagtccattctttcgtcttttcataacctcttccatgtaagttacaagccactagcccgcctcttagaacctctcatttcctttaagacatttgccctgcatttcactccatccttagctaccttccccttgttctttggactctcctcttagcccctcctcttgcttgcttatacccagccccatgaatagcagtgaacggttactcgtagacactttgtactttctcatacaccataaaaatcaaacctccccttctacccagttgctccatcaatccccattacaacctctaacggctgctgcccttactaaatccctaagagtctgggtgcaagacacctgttttggtgctccctcttgtcttttcactttacatttccagttttgccttacaaagttctcttcttggacatgaacagacacttctcaaacgaagacatttatgcagccaaaaaacacatgaagaaatgctcaccatcactggccatcagagaaatgcaaatcaaaaccacaatgagataccatctcacaccagttagaatggcaatcattaaaaagtcgggaaacaacaggtgctggagaggttgtggagaaataggaacacttttacactgttggtgggactgtaaactagttcaaccattgtggaagtcagtgtggcgattcctcagggatctagaactaggaataccatttgacccagccatcccattactgggtatatacccaaaggactataaatcatgctgctataaagtcacgtgcacacgtatgtttattgcactattcacaatagcaaagacttggaaccaatccaaacgaccaacaatgatagactggattaagaaaacgtggcacatatacaccatggaatactatgcagccataaaaaatgagaagttcgtgtcctttatagggacatggatgaaattggaaatcatcattctcagtaaactatcgcaaggacaaaaatccaaacaccgcatgttctcactcataggtgagatttgaacaatgagaacccatggacacaggaaggggaacgtcacactctggtgactgttgtggggtggggggaagggggagggatagcattaggagatatacctaaagctaaatgacgagttaatgggtgcagcacagcagcatggcacacgtatacatatgtaactaacctgcacattgtgcacatgtaccctaaaacttaaagtataataataataataataataataataaaaaagatgtcttcctcctctgtggctccttcacctacatgtgtctacctattaattagacaggcacatgtacactagttagccttacccccaaaatcaatttgcaaataggaccgaacagcttcctgttcccctcatgacactaacactttacttctattttgtttttttattattattattaatataagaaaacaggaacaggccttgacttactcactgctgaaaaaggaagactctgtgtatttttaaatgaagagtgttgtttttacctaaatcagtctggcctggtatatgacaacataaaaaaatgcaaggatagagcccaaaaactcatcaaacaagcaaataattaggctgaacccccttgggcactctctagttgaatgtcctgggtcctcccaattcttagtcctttgatacctgtttttctctttctcttacttggcccttgtgtcttccaattaatctctcaattcctacaaaactgcatccagactatcactaatcactctatatgacaaatgctgcttctaacaaccccacaatatcaccccttaccccaaaatctttcttcagtttaatcactcccactctaggttcccacactgcccctaatcctgctcaaagcagccctgagaaacatcgcccattatctctccataccacccgcaaaaatttttgccaccccaacacttcaccaccattttgttttgtttttcttattaacagaagaagacaggaatgtcaggcctctgagctcaagctaagccatcatatcccctgtgacctgcatgtatacatccagatggcctgaagcaactgaagatccacaaaagaagtgcaaatagccaggtcctgccttagctgacgacattccaccattgtgacctgttcctgccgcaccctaactgatcaattgaccttatgacaatacaccctccccgcccttgcgataatgtactttgagatattcccctacccttgagaaggtactttgtgatatttccccacccttgagaaggtactttgtgatattctcccacccttgagaagttactttgtgatattcccccacccttgagaaggtactttgtgatattcccccacccttgaaaaggtactttgtaatactctccctgcccttgagaatgtactttgtgagatctaccccctgctcctaactccaccgcctatcccaaacctataagaactaacgataatcccaccacactttgctcactctcttttcagactcagcccacctgcacccaggtgattaaaaagctttattgctcacacaaagcctgtttggtggtctcttcacatggacgtgcgtga

SEQ ID NO: 33 - DNA, 568 bp, Homo sapiens
ttacagttggtagctagtcagacatgagcagggcagaagaggcgcccccaccaccaggaatgtcagaagaccatcaggtgaggatcaggcgtttgttaactgtctctaaaataataattgatcagagccagcaccagggaaaggcggcctcccaattcatagaaaaaacctgaagctggtgatcagcagcttccagataagatctcaggaggtgggtgagtgggctcaagcatgcgcactaagaggcaaaacgatggagtttaactggtgtatgaccttatgggaacactcgactggtaagagaagaacgcctcaagtgagcatgcatacaacttcagtaaatacactgtgcatgcagcccctcccaactgctagcaagcaactgcagacactccaccccagaggaagaatcagcggagaaaggatgcaactgttatcaataaaccttcactcctgctctaaaacttgcttcggtctctcactctgccttatgcctctcagttgaattctttcttctgaggaggcaagaagtgaggttgctgaagacctgtacagcttcacagccagt

SEQ ID NO: 34 - DNA, 5576 bp, Homo sapiens
gtcaggcctctgagcccaatctaagccatcatatcccctgtgacctgcacgtacacatccagatggccgattcctgccttaactgatgacattccaccacaaaagaagtgaaaatggcctgttcctgccttaactgatgacattgtcttgtgaaattccttctcctggctcatcctggctcaaaatctcccctactgagcaccttgtgacctccactctgcccaccagagaacaacccccctttgactgtaattttcctttatctacccaaatcctataaaacagccccacccttatctcccttcgctgactctcttttcagactcagcccacctgcacccaggtgaaataaacagctgtattgctcacacaaagcctgtttggtggtctcttcacacagacacgagtgaaatttggtgccgtgacttggatcgggggacctcccttgggagatcaatcccctgtcctcctgcattttgctccatgagaaagatccacctacaacctctggtcctccgaccaaccagcccaaggaacatctcaccaattttaaatccaataagcagccttttttactctcttctccaacctctctcactatccctcaacgtctttcttctttcaatcttggcgccacacttcaatctctcccttctcttaatttcaattcctttcattttctggtagagacaaaggagacacttttatctgtggacccaaaactccggcaccagtcacggactagggaaggcagccgtcccttggtgtttaatcattgcaaggatgcctctctgattattcacccaggtttcagtggtgtcagaccacgcagggacgcctgccttggtccttcacccttagcggcaagtcccgcttttctgggggaggggcaggaaccccaacctcttgtctctgtgcccccatccgttatttctgtgccccgacctcttatctctgtgccccgatcccttatttccatgccctgacctcttatctctgtgccccaaccccttatttccacaccccgaccccttctctgcttttctggagggcaagaaacccccaccccttctctgtgtctctactgtcttttctctgggcttgcctccttcactatgggcaagctttcaccttccattcctccttcttctcccttagcctgtgttcttaagaacttaaaacctcttcaactctcacctgacctaaaatttaaccatcttattttcttctgcaatgccgcttgaccccaatacaaactcgacagtagttccaaatagccagaaaatggcactttcaatttttccaccctacaagttctaaataatttttgtcataaaataggcaaacggtctgaggtgcctgatgtccaggcattcttttacacatcagtccctccctagtctctgttcccaatgcaactcatcccaaatcttccttgtttccctcccacctgtcccctcagtcccaaccccaagtgtcactgagtctttctaatctaccttttctacagacccatctgacctctcccttcctcgccaggccgagctaggtccgaattcttcctcaggctccgctcctccaacctataatctttttatcaactcccctcctcacacccagtccggtttacagtttcattccgtgactagccctccccaacctgcccagcaatttcctcttaaaaaggtggctgaagctaaaggcatagtcaaggttaatgctcctttttctttatctgacctctcccaaatcagtagcgtttaggctgtttcatcaaatatgaaaaacccagcccagttcatggctcgttcggcagcaaccctgagactctttacagccctagaccctaaaaggtcaaaaggccatcttattctcaatatacgttttattacccaatctgctcctgacattaaataaaactccaaaaattaaattctggccctcaaaccccacaacaggacttaattaacctcaacttcaaggtgtacaataatagagtagaggcagccaagtagcaatgtatttctgagttgcaattccttgcctccactgtgagacaaaccccagccacatctccagcacacaagaactccaaaggcctgaaccgcagctgccaggggttcctccagaacctcctcccccaggagcttgctacaagtgctggaaatctggccactgggccgaggaacacccacagcccaggattcctcctaagccgtatcccatctgtgtgagaccccactgaaaatcagactgttcaactcacctggcagccactcccagagcccctggaactctggcccaaggctctctgactgactccttcccagatcttcttagcttagcggctgaagactgactctgtccgattgcctcggaagccccgtagaccatcatggacgccgagctttgagtaactctcacagtggaaagtaagtccgtcctcttcttaatcaatatggaggctacccactccacattaccttcttttcaaaggcctgtttcccttgcctctataactgttgtgggtattgacggccaggcttctaaacctcttaaaacttcccaactctggtgccaacttagacaatactcttttaagcactcctttttagttatccccacctgcccagttcccttattaggcagagacactttaactaaattatctgcttccctgactattcctggattacagctacatcttactgccgcccttcttcccaatccaaagcctcctttgagtcctcctcttgtatccccccaccttaacccacaagtataagatacctctactccctccttggcgactgatcacacactccttaccatctcattaaaacctaaccacctttaccccgattaatgccaatatcccatcccacagcatgctttgaaagggttaaagcctgttatcactcacctgctacagcatggccttttaaagcctataaactctccttacaattcccccattttatctgtctaaaaccagacaagccttacaagttagttcaggatctatgacttatcaaccaaattgttttgcctatccaccccatggtgctaaacccatatactctcctatcctcaatacctccctccacaatccattattctgttccagatctcaaacctgctttctttactattcctttgcacccttcatcccagcctttctttgctttcacctggactgaccctgacacccatcaagctcagcaaattacctaggctgtactgccgcaaagcttcacaggcagcccccattacttcagtcaagcccaaatttcttcctcatctgttacctatctcggcataattctcataaaaacacatgtgctctccctactgatcgtgtctgattaatccctaaacctcaatcccttacaaaacaacaactcctttccttcctaggcatggttagtgcggtcagaattcttatacaagagccaggactgcaccctgtagcctttctgtccaaacaacttgaccttactgttttagcctagccctcatgtctgcatgcagtggctgccactgctttaatacttttagaggccctaaaaatcacaaactatgctcaacacactctctacatttctcataacttccaaaatctattttcttcctcatacctgatgcatatactttctgctcccggctccttcagctgtactcactctttaagtccgacaattaccattgttcctggcccggacttcaatctggcctcccacattattcctgataccacacctgacccccatgactgtatctctctgatccacctcatttccccatgtttccttctttcctgttcctcaccctgatcacgcttgatttattgatggcagttccaccaggcctaatcgccacacaccaccaaaggcaggctatgctatagtacaagccactagcccgcctcttagaacctctcatattctttccatcgtggaaatctatcctcaaggaaataacttctcagtgttccatctgctattctactactcctcagggattattcaggcctcctcccttccctacacatcaagctcgaggatttaccccaacccaggactggcaaattagctttactcaacattccccatgtcagataactaaaataccgcttagtctaggtagacaatttcactggataggtagaggcctttcctacagggtctgagaaggccaccatagtcatttcttcccttctgtcagacacaattcctcagtttagccttcccatgtctatacagtctgataacagatcagcctttattagtcaaatcagccaagcagtttttcaggctcttagtattcagtgaaagctttatatcccttacagtcctctgccttcaggaaaagtagaacggactaaaggtcttttaaaaacacaccacaccaagctcagccaccaacttaaaaaggactggatgatacttttaccactttcccttctcagaagtcagacctgtcctcagaatgctacagcgtacagcccatttgagctcctgtacagacggtcctttttattaggccccagtctcattccagacgccagaccaacttagactgtgcccccaaaaaacttgtcatccctactatcttctgtctagtcatactcctattcaccgttctcaactactcatacatgccctgctcttgtttacactgccagtttacactgtttctccaagccatcacagctgatatctcctggtgctatccccaaactgccactcttaactcttgaagtaaataaataatctttgctggcaggactatgctgaatctccttaggcactctctaatctgatgtcctgggtcctcccaattcttagaccttttatacctgtttttctccttctgttattccatttagtttttcaattcatacaaaaccatatccaggccatcaccaataattctacacaacaaatatttcttctaacaaccccacaatatcaccccttaccacaaaatcttccttcagcttaatctctcccactctaggttcccacgccgcccctaatcccacttgaagcagccctgagaaacatcgcccattctctctccatatcacccccccaaaattttcaccaccccaacactttaccactatttcattttatttttcttattaatataagaagacaggaatgtcaggcctctgagcccaagctaagccatcatatcccttgtgacctgcacgtacacatccagatggccggttcctgccttaactgatgacattccaccacaaaagaagtgaaaatggcctgttcctgccttaactgatgacactgtcttgtgaaattccttctcctggctcatcctggctcaaaagctcccctactgagcaccttgtgacccccactctgcccgccagagaataacccccctttgactataattttcctttatctacccaaatcctataaaatggccccatccttatctcccttcactgactgttttcggactcagcccacctgcacccaggtgaaataaacagctttattgctcacacaaacctgtttggtggtctcttcacatggacgcgagtgaaa

SEQ ID NO: 35 - DNA, 355 bp, Homo sapiens
ccacaaaagaagtgaaaatagccagttcctgccttaactgatgacattccaccattgtgatttgttcctgccccaccctaactgatcaattgaccctgtgacattctttctcctggacaatgagccttagaagctccccaccgagcaccttgtaacccccacccctgcccacaagagaaaaaccccctttgactgtaattttccactatctacccaaatcctataaaactgccccaccccatctccctttgctgactcctttctcggactcagcccacttgtacccaagtgaataaacagccttgttgcttacacaaagcctgttggtagactcttttcacacaaatgcgtgtga

SEQ ID NO: 36 - DNA, 3318 bp, Homo sapiens
caggcctctgagcccaagctaagccatcatatcccctacgaccggctcatatacgttcaaatggcctgaagcaactgaagatctacaaaagaagtgaaaatagccttagctgatgacattccaccattgtgatctgtttctgccccaccctaactgatcaatatactttgtaatctcccccacccttaagaaggttctttgtaggccgggcacggtggcccaagcctgtaatcctagctctttgggaggccgaggcgggcagatcacgaggtcagaagatcaagaccatcctggctaacacggtgaaaccctgtctctactaaaaatacaaaaaaaaattagctgggcgtagtggcgggcgcctgtggtcccagctactccggaggctgaggcaggagaatggcttgaactcgggaggcggagcttgcagtgagccgagaaagagccactgcactccagcctgggcgacagagccagactccgtctcaaaaaaaaaaaaaaaaaggttctttgtaattctccccacccttgagaatgtactttgtgagatccacccctgcccacagaacattgctcctaactccaccgcctatcccaaaacctataagaaccaatgataatcccactaccctttgatgactctctttttggactcagcccgcctgcacccaggtgaaataaacagcctcgttgctcacacaaagcctgtttggtggtctcttcacacggacgcatgagacatttggtgccgaagacccgggtcagcgggactccttcgggacagcagtcccctgtcctcaccttcactccctgaagagatccacctacaacctcaggtccgcagaccaaccagcccaaggaacatctcactgattttaaattgggtaagtggcctcttttactccttctccaacctctctcactatccctcaacctctttctcctttcaatcttggcaccatccttcaatctctcccttctcttaatttaaattcctttcattttctggtatagacaaaggagacacattttatccgtggacccaaaactctggcgccggtcacggacttgggaaggcagccttcccttggtgtttaatcattgtggggacgactgcctgattattcacccacattccatttgtgtctgatctccgcggggacacctgccttggtcattcacccacatcccttggtggcaagtcaattgcagggacgcctgctttggctgctcaccttaccccttctctccgtgtctctaccccttctctactttcctgaggggcaagcaccccccaccccgtttccattttcctggggggcaagcacctcccatcccttctccactttcctgggggataagcatcccccaccccttctctccgtgtctctacccttctctttaaacttgcctacttcactatgggcaaccttccaccctccattcctccttcctctcccttagcctgtgttctcaagaacttaaaacctcttcaactctcgcctgacctaaaacctaaatgtcttattttcttctgcaatgccgcttgaccccaatacaaaccagacagtggttccaaatagccaaaaaatggcactttcaatttttccatcctacaagatctaaataattcttgtcataaaatgggcaaatggtctgaggtgcctgacgttcaggcattcttttatacatcggtccctccctagtctctgttcccaatgcagttcatcccaaatcttccttctttccctcctgcctgtcccctcagttccaaccccaagcgttgctgagtcttgaatcttccttttctacaaacccatctgacttctcccctccttcccaggctgctcctcaccaggccgagctaggtcccaattcttcctcagcctctgctcctccaccctataatccttttattacctcccctcctcacacccagtccagcttacagtttctttccgtgactagccctcctccatctgcccaacagtttcctcttaaagaggtggctggagctaaaggcacagtcaaggttaatgctcctttttctttatccgacctctcccagatcagttagcgtttaggctctttttcatcaaatataaaacccagcccagttcatggcccatttggcagcaatcctgagatgttttacagccctagaccctgaaaggtcacaatgccgtcttattctcaaaatgcattttattttattacccaatctgctcctgacattaaataaagctccaaaaattaaattccggccctcataccccacaacaggacttaattaacctcgccttcaaggtgtacaataataagagtagaggcagccacgtagcaatgtatttctgagttgcaattccttgcctccaccgtgagacaaaccccagccacatctccagaacacaagaactccaaacgcctgaaccgcagctgccaggggttcctccagaacctcctcccccaggagcttgctacaagttttggaaatctggccaccgggccaaggaatgcccgcagcccgggattcctcctaagccatgtcccatctgtgaaggacccccaatgaaaatcagactgttcaactcacctggcagccactcttttgtttagtttctcagttcatacaaaaccgcatccaggccatcaccaataattctatacgacaaacactccttctaacaaccccacaatatcaccccttaccccaaaatcttccttcagcttaatctctcccactctaggttcccacaccaacccctaatcccgctcgaagcagccctgagaaacatcgcccattatctctccataccaccccaaaaaattgttgccaccccaacactttaccactatttcgttttatttttcttattaatataagaagacaggaatgtcaggcctctgagcccaagctaagccatcatatccccagtgacctgctcgtatacatctagatggcctgaagcaactgaagatccacaaaaaaagtgaaaatagccttaactgatgacattccaccattgatttgtttctgccctaccctaactgatcaatgtactttgtaatctccccccaacccttaagaaggttctctgtaattctccccacccttgagaatgtactttatgagattcaccctctgcctgcaaaacattgctcctaactccactgcctatcccaaaacctataagaacaatgataatcccaccaccgttgctgactcctttttcggactcagcctgcctgcacccaggtgaaataaacagccttgttgctcacacaaagcctgtttggtggtctcttcacacagacatg

SEQ ID NO: 37 - DNA, 6223 bp, Homo sapiens
atcaggcctctgagcccaagccggcaggtatacatccagatggcctgaggcaactgaagaatcacaaaagaagtgaaaatggccggtttctgccttaactgataacattatctcgtgaaattccttctcctggacaacgagtatcagaagctccccactgagcaccttgtgacccccacccctgcctgccagagaacaacccctttgactgtaattttccactacctacacagatcctataaaactgtgccacccctatctcccttcactgactctcttttcggactcagcccgcctgcacccaggtgattaaaaagctttattgctcacacaaagcctgtttggtggtcccttcacacagacgcatgtgacatttggtgccatgacttggatcgggggacctcccttgggagatcaatcccctgtcctcctgctctttgctccatgagaaagatccacctacgacctcagatcctcagaccaaccagcccaaggaacatctcaccaattttaaatcgggtaagcggcctctttttactctcttctccaacctctctcactgtccctcaacctctttctcctgaatttcagcaccacccttcaatatctcccttcccttaatttcagttcctttccttttctggtagagacagaggagacacatttgatccatggacccaaaactccggcaccagtcatggactcgggaagacagtcttcccttggtgtttaatcactgcagggatgcctgcctgatgattcacccacatttcagaggtgtctgatcactgcagggatgcctgctgtgatccttcaccttggtggcaagcaccacctcccctgggggcaagtacccaccccctcccgtgtctccaccctctcttttctctgggcttgcctcttcactataggcagccttccaccctccattcctccttcttctcccttagcctgtgttctcaagaacttaaaacctcttcaactctcctgacccaaaatctaaatgccatattttcttctgcaataccacttgaccccaatacaaattcgaaaatggtttcaaatagccagaaaatggcactttcagtttctctatccttcaagatctagatcattctggtcgtaaaatgggcaaatgctctgaggtgcctgatgtccaggcattcttttacacatcggtccctccctagtctctgctcccaatgcaactcatcccagatctttcttctttctctcctgtctgttccttcagtctccaccccaagctctgagtcctttgaatcctccttttctacagacccatctgacctctcccatcctccccaggctccttcttgccaggccgagccaggtcctaattcttcctcagcctccactcccccaccctataatccctctatcactcccttcctcacacccagtccagcttacagtttcattccacaactagccctcccccacctgcccaacaatttcctcttaaagaggtggctggagctgaaggcttaatcaaggttaatgctcctttttctttatcctacctctcccaaatcagttagtgtttaggctctttttcatcaaatataaaaacccagtccagttcatggcccatttggcaacaacccttagatgctttactgccctagacccagagaggccagaaggccatcttattctcaatatacattttattacccaatctgctcctgacattacaaaaagctccaaaaattagattccagccctcaaaccccacaacaggacttaattaacctcaccttgaaggtgtacaataatagagaagagttgcaattacttgcctgcctccgctgtgagacaaatcccagccacatctccagcatacaagaacttcaaaacgcctaaaccacagtgtccaggcattcctccaggacctcctcccccaggatcttgcctcaagtgcgggaaatctggccactgggccaaggaatgcccgcagcctgggattcctcctaagccatgtcccatctgtgcaggaccccactggaaatcagactgtccagctcgcccagcagccactcccagagcccctggaactctggcccaaagctctctgattgactccttcccagatcttcttaacttagcagctgaaaactgacactggccaatcgccttggaagcctcctggaccatcgcagatgctttgggtaactcttacagtgaagggtaagtccgtcctcttcttaatcaatatggaggctgcccactccacattaccttcttttcaagggcctgtttcccttgcctccataactattgtgggtattgatggccaggcttctaaacctcttaatactcccccactctggggccaacttggacaacattcttttatgcagtctgttatagttatccccacctgcccagttcccttattaggccaatacattttaaccaaattatctgcttctctgaccattcctggactacagccacatctcattgccacctttcttcccaacccaaagcctccttcgcatcttcctcttgtatccccccaccttaacccacaggtatgggacacctctactccctccctggcaactgatcacacacccattactatcccattaaaacctaatcacccttacccagctcaacgccagtatcccatcccacaataggctttaaggggactgaagcttgttatcacttgcctgctacagcatggccttttaaagcctataaactctccttacaattcccccattttacctgtccaaaaaccagacaagtcttacaggttagttcaggatctgcgctttatcaaccaaattgtcttgcctatccaccccgtggtgccaaactcatatactctcctgtcctcaatccctccctccacaacccactattctgttctggatctcaaagatgctttctttactattcctttacacccttcatcccagcctttcttcgctttcacttggactggccctgacacccaccagtcttagcagcttacctcggcttactatcgcaaggcttcatggacagcccccattacctcagtcaagccctttctcatgatttactttctttccaaccatctacttctcaccttaatgaatattttgataaccttctactttatacccctcctacaaatcttcccaacaggacaccctcctgctcctccaacacctattcgcgcatccccctccaaagcccaaatttcttcctcatccattatctatctcgacataattcttcatgaaaacacatgtgctctccctgctgattgtgtctggctaatctcgcaaaccccaaccccttctacaaagcaacaactcctttccttcctaggcatggttaggtacttttgcctttggatacctggtattgccatcctaactaaaccattcattctccccatttccccatatttccctctttcctgttccccacccagaccacacttagtttattgatgacagttcttccaggcccaatcaccaatcactggcaaaggcaggctatgttatagtgtcttccacatctatcattgaggctaccactctgccccactccactgcctctcagaaagccaaactcattgccttaactcgagccctcactcttgcaaaaagactgcatgtcaatatttatgctgattctaaatatgccttccatctcctgcaccaccatgctgtttatatagactaaaagaggtttcctcactacacaaggtcctccatcattaatgcccccttaataaaaaaaactcttcttaaagcttctctactcccaaaaaagctaaggtcattcactgcaaatgccatcaaaaggcatcagaccccactgctcaaggcaacaattatgctgataagacagctaaagaagcagccaggattcctacttctgtccctcatggccagtttttctcctactcatcagtcactcctatttactctcccactgaagtttccacctatcagtccctccccactcaaggcagatgatttttagaccaaaaaaaatccccttccagcctcacaggcccatgctattctgtcgtcatttcataaccccttccatgtaagttacaagctgctagcccgcctcttaaaacctctcatttcctttccatggtaaaaatctatcctcaaaaaaatcacttctcagtgttccatctgctattctactactcctcagggatttctcaggccccctcccttccctacacattaagcttgaggagttgcccctgcccaggactggcaaattgactttactcacatgccccgagtcaggaaactaaaatacctcttggtctggaaagacacattcactggataggtagaggcctttcccacagggtctgagaaggccaccatggtcatttctttccttctgtcagacataattcatcttcttgctcagccccaacctcgtcccagacaccagccctctaagcgactctcttccagtcctccagcaggctagacaggaaattcgccaagctgctaatcttttcttgcctactccagattcccagccatatgaagacaccctagctggacaatcagttcttattaagaatctcacacctcaaactctacagcctcgatggaccagatgctacttagtcatctatagtaccccaaatgccatccacctgcaggaccctccccattaggttcacaactccagaataaagcatgtccattggacagccagcctgatctctcttcttcctcctggaagtcgcagatactctcccctacttcccctaaactcactcgcatttctgaagagcagtaataacccttatgagcctaatacatcccttcattctattaggtcttagtccttaccctactttttgcaacagggctttacgcaatcacccccactacttggactgcacaccaaaaaatttgtcatccctcctatcttctgtctagtcatactcctattcaccattctcaactagtcataaatgccctgcccctgtttacgttgctggtttacacatttcctccaaaccatcgtagaggatatctcctggtactatcctcaatccaccactcttgactccctcttggagtggatagatgatctttgctgacagggcactctccaatactttgaccctgatgaagtcctattcttttcttttatactcactcttattctccaccctttacctctccccggctatctccaccacactatcaatctcactcactctctcctagccatttctaatccttctttaacaaacagttgctggctttgcatttcgctttcctccaaaaccgctgaggcctcgacttactcaatgctgaaaaagaaagactccgtatatttttaaatgaagagtgttgtttttacctaaatcaacctggcctggtatatgacaacataaaaaaaaaaaaaaaaaaactcaaggatagagcccaaaaactcaccaaccaagcaagtaattatgctgaacccctttgggcactctctaattgaatgtcctgggtcctcccaattcttagtcctttaatacctgtttttctccttctcttattcggaccttgtgtcttctgtttagtttctcaattcatataaaaccacatccaggccatcaccaatcattctatgacaaatgctccttctaacaaccccacaatatcaccccttacccaaaaatctttcttcagtttaatctctcccactctaggttcccaggccacctctaatcccgctcaaagcagccctgagaaacatcacccattatctcttcataccacccccaaaattttttgccgccccaacacttcaccactattttgttttatttttcttattaatataagaagacagggatgtcaggcctctgagcccaaacccgcacgtacacatccagatggcctaaggcaactgaagaatcacaaaagaagtgaaaatggtcagttcctgccttaactgatgacattatcttgtgaaattccttctcctggacaatgagtctcagaagctcctctccgagcaccttgtgaactccgcccctgcccgccagagaacaacccctttgactgtaattttccactacctacacaaatcctataaaactgccccaccccatctcccttcgctgactctcttttcagactcagcccacctgcacccaggtgattaaaaagctttattgctcacacaaagcctgttgacacatggacgcgcatga

SEQ ID NO: 38 - DNA, 10844 bp, Homo sapiens
gtggggaaaagaaagagagatcagactgttactgtgtctatgtagaaagaaatagacataagagactccattttgttctgtactaagaaaaattcttctgctttgagatgctgttaatctgtaaccctagccccaaccctgtgctcacagaaacaggtgctgtgttgactcaaggtttaatggattcagggctgtgcaggatgtgctttgttaaacaaatgcttgaaggcagcaagcttgttaagagtcatcaccactccctaatctcaagtaagcagggacacaaacactgcggaaggccgcagggacctctgcctaggaaagccaggtgttgtccaaggtttctccccatgtgacagtctgaaatatggcctcttgggaagggaaagacctgactgtcccctggcccgacacccgtaaagggtctgtgctgaggattagtaaaagaggaaggaaggcctctttgcagttgagataagaggaaggcatctgtctcctgctcatccctgggcaatggaatgtcttggtgtaaagcctgattgtatatgccatctactgagataggagaaaactgccttagggctggaggtgggacatgctggcggcaatactgctctttaaggcattgagatgtttatgtatatgcacatcaaaagcacagcacttttttctttaccttgtttatgatgcagagacatttgttcacatgttttcctgctggccctctccccactattaccctattgtcctgccacatccccctctccgagatggtagagataatgatcaataaatactgagggaactcagagaccggtgcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtggtaagcttgggcgctcggaagaagccagggttaatggggcaaactaaaagtaaagtctctcattccacctgatgagaaacacccagaggtgtggaggggcaggccaccccttcagggtagggtcccctccatgcagaccatagagcacaggtgtgccccaaagaggagcagagagaaggagggagagggcccacgagagacttggaaatgaatggcaggattttaggcgctggacttgggttcggggcacctggcctttccttgtgtatttctcctactgtctgcctaactatttaatacaataaaagaaaaccagcccctggttcttgtggtgtttccaccctcccgggtccccgctggctgcctggcttcctcccgcagctcctgctgtgtgtgtatgtgtgtgtgtgtgcacatctgtggggcgtatgtgtgttcgtctttgtaattgaggctgcagagtggagagagcaggggttttctctggggacccagagagaaggaggcgttttcaccacagccgaacagggcaggaccccagcacccgggacccagcgggactttgccaaggggatggacctggctgggccacgcggctgtttgtgtagggaaaagaaagagagatcacactgttactgtgtctatgtagaaaaggaagacataaactccattttgagctgtactaagaaaaattattttgccttgacctgctgttaacctgtaactgtagccccaaccctgtgctcaaagaaacatgtgctgtatggaatcaaggtttaagggatcaagggctgtacaggatgtgccttgttaacaatgtgtttacaggcagtatgcttggtaaaagtcatcgccattctccattctccattaatcaggggcacgatgcactgcggaaagccacagggacctctgcccgagaaagcctgggtattgtccaaggcttccccccactgagacagcctgagatacggcctcgtgggaagggaaagacctgaccgtcccccagcccgacacccgtaaagggtctgtgctgaggaggattagtaaaaggggaaggcctcttgcagttgagataagaggaaggcctccgtctcctgcatgtccttgggaatggaatgtcttggtgtaaaacccgatagtacattccttctattctgagagaagaaaaccaccctgtggctggaggtgagatatgctagcggcaatgctgctctgttactctttgctacactgagatgtttgggtggagagaagcataaatctggcctatgtgcacatctgggcacagaacctccccttgaacttgtgacacagattcctttgttcacatgttttcctgctgaccttctccccactatcgccctgttctcccaccgcattccccttgctgagatagtgaaaatagtaatctgtagataccaagggaactcagagaccatggccggtgcacatcctccgtacgctgagcgctggtcccctgggcccattgttctttctctatactttgtctctgtgtcttatttctttcctcagtctctcatccctcctgacgagaaatacccacaggtgtggaggggctggcccccttcatctgatgcccaatgtgggtgcctttctctagggtgaaggtactctacagtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctcctcccgtggttcagatgcctgtaacattacaacctcaaacgcaggttagacaagcacaaaccccaagagaaaatcaagtagaaagggacagagtctctatcccggcaatgccaactcagatacagtatccacaatatcagccggtagaaaataagacccaaccgctggtagtttatcaataccggctgccaaccgagcttcagtatcggcctccttcagaggttcaatacagacctcaagcggtgtgtcctgtgccaaatagcacggcaccataccagcaacccacagcgatggcgtctaattcaccagcaacacaggacgcggcgctgtatcctcagccgcccactgtgagacttaatcctacagcatcacgtagtggacagggtggtgcactgcatgcagtcattgatgaagccagaaaacagggcgatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcaatgctaatggctcaagcaatgagggggctcactctaggaggacaagttagaacatttgggaaaaaatgttataattgtggtcaaatcggtcatctgaaaaggagttgcccaggcttaaataaacagaatataataaatcaagctattaacagcaaaaaataaaaagccatctggcctgtgtccaaaatgtggaaaagcaaaacattgggccaatcaatgtcattctaaatttgataaagatgggcaaccattgtctggaaacaggaagaggggccagcctcaggccccccaacaaactggggcattcccagttaaactgtttgttcctcagggttttcaaggacaacaacccctacagaaaataccaccacttcagggagtcagccaattacaacaatccaacagctgtcccgcgccacagcaggcagcaccgcagtagatttatgttccacccaaatggtctttttactccctggaaagcccccacaaaagattcctagaggggtatatggcccgctgccagaagggagggtaggcctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcagaagtgtatcaaagtgccatgattttacattgtccaggatctgataatcaagaaagtacggttcagcctgtgatcacttcattccaatcaatttatggggccgagacttgttacaacaatggcatgcagagattactatcccagcctccctatacagccccaggaataaaaaaatcatgactaaaatgggatagctccctaaaaagggactaggaaagaagtcccaattgaggctgaaaaaaatcaaaaaagaaaaggaatagggcatcctttttaggagcggtcactgtagagcctccaaaacccattccattaacttgggggaaaaaaaaacaactgtatggtaaatcagcagcgcttccaaaacaaaaactggaggctttacatttattagcaaagaaacaattagaaaaaggacattgagccttcattttcgccttggaattctgtttgtaattcagaaaaaatccggcagatggcgtataatgccgtaattcaacccatgggggctctcccaccccggttgccctctccagccatggtcccctttaattataattgatctgaaggattgcttttttaccattcctctggcaaaacaggattttgaaaaatttgcttttaccacaccagcctaaataataaagaaccagccaccaggtttcagtggaaagtattgcctcagggaatgcttaatagttcaactatttgtcagctcaagctctgcaaccagttagagacaagttttcagactgttacatcgttcactatgttgatattttgtgtgctgcagaaacgagagacaaattaattgaccgttacacatttctgcagacagaggttgccaacgcgggactgacaataacatctgataagattcaaacctctactcctttccgttacttgggaatgcaggtagaggaaaggaaaattaaaccacaaaaaatagaaataagaaaagacacattaaaagcattaaatgagtttcaaaagttgctaggagatactaattggatttggagatattaattggatttggccaactctaggcattcctacttatgccatgtcaaatttgttctctttcttaagaggggactcggaattaaatagtgaaagaacgttaactccagaggcaactaaagaaattaaattaattgaagaaaaaattcggtcagcacaagtaaatagaatagatcacttggccccactccaaattttgatttttgctactgcacattccctaacaggcatcattgttcaaaatacagatcttgtggagtggtccttccttcctcacagtacaattaagacttttacattgtacttggatcaaatggctacattaattggtcagggaagattatgaataataacattgtgtggaaatgacccagataaaatcactgttcctttcaacaagcaacaggttagacaagcctttatcaattctggtgcatggcagattggtcttgccgattttgtgggaattattgacaatcgttaccccaaaacaaaaatcttccagtttttaaaattgactacttggattttacctaaagttaccaaacataagcctttaaaaaatgctctggcagtgtttactgatggttccagcaatggaaaagtggcttacaccgggccaaaagaatgagtcatcaaaactcagtatcacttgactcaaagagcagagttggttgccgtcattacagtgttaacaagattttaatcagtctattaacattgtatcagattctgcatatgtagtacaggctacaaaggatattgagagagccctaatcaaatacattatggatgatcagttaaacccgctgtttaatttgttacaacaaaatgtaagaaaaagaaatttcccattttatattactcatattcgagcacacactaatttaccagggcctttaactaaagcaaatgaacaagctgacttgctagtatcatctgcattcatggaagcacaagaacttcatgccttgactcatgtaaatgcaataggattaaaaaataaatttgatatcacatggaaacagacaaaaaatattgtacaacattgcacccagtgtcagattctacacctggccactcaggaggcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcagttcaaaaattcttaaatcagtggaaaattacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccaggtaaacaaaatggtgatatcagaagaacagaaaaagttgccttccatcaaggaagcagagttgccaatataggcacaattaaagaagctgacacagttagctaaaaaaaaaagcctagagaatacaaaggtgacaccaactccagagaatatgctgcttgcagctctgatgattgtatcaacggtggtaagtcttcccaagtctgcaggagcagctgcagctaattatacttactgggcctatgtgcctttcccacccttaattcgggcagttacatagatggataatcctattgaagtagatgttaataatagtgcatgggtgcctggccccacagatgactgttgccctgcccaacctgaagaaggaatgatgatgaatatttccattgggtatccttatcctcctgtttgcctagggaaggcaccaggatgcttaatgcctacaacccaaaattggttggtagaagtacctacagtcagtgctaccagtagatttacttatcacatggtaagtggaatgtcacagataaataatttacaggacccttcttatcaaagatcattacaatgtaggcctaaggggaaggcttgccccaaggaaattcccaaagaatcaaaaagcccagaagtcttagtctgcggagaatgtgtggctgatactgcagtgtagtacaaaacaatgaattttgaactatgatagactgggtcccttgaggccaattatatcataactgtacaggccagactcattcatgttcacaggccccatccatctggcccattaatccagcctatgacggtgatgtaactgaaaggctggaccaggtttatagaaggttagaatcactctgtccaaggaaatggggtgaaaagggaatttcatcaccttgaccaaagttagtcctgttactggtcctgaacatccagaattaggaagcttactgtggcctcacaccacattagaatttgttctggaaatcaagctataggaacaagagatcgtaagtcatattatactatcaacctaaattccagtctgacaattcctttgcaaaattgtgtaaaactcccttatattgctagttgtaggaaaaacatagttattaaacctgattcccaaaccataatctgtgaaaattgtggaatgtttacttgcattgatttgacttttaattggcagcaccgtattctactaggaagagcaagagagggtgtgtggatccttgtgtccatggaccgaccatgggaggcttcgctatccatccatattttaacggaagtattaaaaggaattctaactagatccaaaagattcatttttactttgatggcagtgattatgggcctcattgcagtcacagctactgctgcggctgctggaattgctttacactcctctgttcaaactgcagaatacgtaaatgattggcaaaagaattcctcaaaattgtggaattctcagatccaaatagatcaaaaattggcaaaccaaattaatgatcttagacaaactgtcatttggatgggagaggctcatgagcttggaatatctttttcagttacgatgtgactggaatacatcagatttttgtgttacaccacaagcctataatgagtctgagcatcactgggacatggttagatgccatctgcaaggaggagaagataatcttactttagacatttcaaaattaaaagaattttttttttctttgagacagagtctcgctctgtcgcccaggctggagtgcagtggcgtgatctcagctcactgcaagttccgcctcctgggtttacaccattctcctgcctcagcctcccaagtagttgggactacaggagcccaccaccatgcctggctaattttttttgggtttttaatagagatggagtttcaccgtgttagccaggatggtctcgatctcctgaccttgtgatctgcccaccttggcctcccaaagtgctgggattacagtcgtgagccaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgcctgttctgtctgttgttagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgt

SEQ ID NO: 39 - DNA, 5745 bp, Homo sapiens
gtcaggcctctgagcccagctaagccatcatatcccctgtgacctgcacatacacacctagatggccagttcctgccttaaccaatgacagtccaccacaaaagaagtgaaaatggcctgttcctgccttaactgatgacattatcttgtgaaattccttctcctggctcatcctggctcaaaacgtcccctgctgagcaccttgtgaccccccactcctgcctgccagagaacaaccccacttcttcctttacctacccaaatcttataaaatggccccaccctatctccctttgctgactgtctttcggactcagcccggttgcacccaggtgaaataaacagccttgttgctcacacaaagccggtttggcggtctcttcacacagacgtccatgaaatttggtgccgtgactcggatcgggggacctcccttgggagatcaatcccctgctctcctgctctttgctccgtgagaaagatccacctatgacctcaggtcctcagaccgaccagcccaaggaacatctcactaatttcaaatctggtaagtggcctctttttactctcttctccaacctccttcactatccctcaacctctttctccttcaatcttggcaccacacttcaatctctcctttctcttaacttcagttcctttccttttctggtagagacaaaggagatgcgttttatccatggacccaaaactccggcgccggtcacggactcaggaaggcaggcttcccttgctgtttaatcattgcgggacgcctctctgattattcacccacgttccattggtgtctgatctccgtggggatgcctgccttgatcattcacccatgttcccttggtggcaagtcaattgcggggacgcctgctttggctgctcacccacattgcagcccagagctgctccccacccccttctccgtgtctctacccttctctttaaacttgcctccttcactataggcaaccttccaccctccattcctcctcctcccttagcctgtattctcaagaacttaaaacctcttcaactcacacctgacctaaaacctaaacaccttattttcttctacaatgacacttgaccccaatacaaactcgacagtagttccaaatagccagaaaatggcacttgctatttttccatcccacaagatctaaataattcttgtcgtaaaataggcaaatggtctgaggtgcctgacgtccaggcattcttttacacattggtccctccctagtctctgttcccaatgcaactcgtcccaaatcttccttctttccctcctgcctgtcccctcagtcccaaccccaagtgtcactgagtctttctaatcttccttttctacagatccatctgacctctccccagctcggcaggccaagctaggtcccaattcttcctcagcctctgctcctccaccctataatccttttatcacctcccctcctcacactcggtctggcttacagtttcattctgtgactagccctcccccacctgcccggcaatttcctcttaaaaaggtggctggagctaaagccataatcaaggttaatgctcctttttctttatcgcaaatcagatagcatttaggctctttttcatcaaatataaaaatccagcccagttcatggcttgtttggcagcaaccctgagatgctttacagccctagaccctaaaaggtcaaaaggccatcttattctcaatatacattttattacccaatccactcccaacattaaataaaactccaaagactaaattccagccctcaaacccctcaacaggacttaattaaccttgcctttgaggtgtacaataatagagtagaggcagccaaatagcaacatattcctgagttgcaattccttgcctccactgtgagacaaaccccagccacatctccagcacacaagaacttccaaacgcctaaaccgcagtggccaggcattcctccagaactgcctcccccaggagcttgctacaagtgccagaaatctggccaccaggccaagggatgcccgcagcccaggattcctcctaagccacatcccatctgtgcaggaccccactggaaatcagactgtccaactcacctggcagccactcccagagcccctggaactctggcccaaggctttctgactgactccttcccagatcttctcggcttagcagctgaagactgacactgcccaatggcctcagaagccccctagaccatcatggatgccgagcttcgaatagctctcacagtggaaactaagtccgtccccttcttaatcaatacggaggctacccactccacattaccttcttttcaagagtctgtttcccttgcctccataactgttgtaggtattgatggccaggcttctaaacctcttaaaactccccaactctggtgccaacttagacaatacctttttaagcactcctttttagttatccccacctgcccagttcccttattaagctgagacattttaactaaattatctgcttccctgactattcctggactacagccacatctcattgccacctttcttcccaatccaaagcctcctttgtgtcctcctcttgtacctgccccccccaccttaacccacaagtataggatacctctactccctccttggtgaccgatcatgcactccttaccatctcattaaaacctaatcacccttaccccgctcaatgccaatatcccatccgcagtgcactttaaaaagattaaagcctgttatcactcgcctgctacagcatggccttttaaagcctataaactctccttacaatttccccattttacctgtcctaaaaccagacaagccttacaagttagtttaggatctgcgccttatcaaccaaattgttttgcctatccatcctgcggtgccaaacccatagactctcctatcctcaatacctccctccacaacccattattctgttctggatctcaaacatgctttctttactattcctttgcactcttcgtcccagcctctctctgctttcacttggactgacccttggactgaccctgacatgcatcacgctcagcaaattacgtgggctgtactgccgcaaagcttcacaaacagtccccattacttcagtcaagcccaaatttcgtcctcatctgttacctatctcggcataatgctcataaaaacacacgtgctctccctgccaatcatgtctgactgatctctcaaaccccaacaccttctacaaaacaactcctttccttcctaggcatggttacatactttcaactttagatacctggttttgccatcctaacaaaaccattatataaactcacaaaaggaaacctagctgaccccatagatcctaaatccttttcccactcctctttccattccttgaagacagctttagagactgcccccaccctagctctccctgactgatcccaacccttttcattacccacagccgaagtgcagggctgtgcagtcagaattcttacacaagaaccgggaccgtgccctgtagcctttttatgcaaacaacttgaccttactgttttgcctagccctcaagtctgcgtgcagtggccgccacgaccctaatactttcagaggcccttaaaatcacaaactatgttcaactcgctctctacagttctcataacttccaaaatctattttcttcctgacacctgacacatatactttctgctccccagctccttcagctgtactcactctttgttgagtctcccacaattatcattgttcctggcccagacttccatccggcctcccacattattcctgataccacacctgacccctatgactgtatctctctgatccacctgacattcaccccatttccccgtatttccttctttcatgttcctcaccctgatcacacttggtttattgatggcagttccaccaggcctaatcgccacacaccagccaaggcaggctatgctatagtagaagccactagcctacctcttagaacctctcatttcctttccatcatggaaatctatcctcaaagaaataacttctcagtgttccatctgctattctactatttctcagggatgattcaggccccctcccttccctacacatcaagctcagggatttgcccccacccaggactagcaaatttgctattctactacttctcagggattattcaggccccctccgtccctacacatcaaactcaaggatttgcccctgcccagaactggcaaattgactttactcaacacgccccgagtcaggaaactaaaatacctcttggtctaggtagacactttcactggataggtagaggcctttcccacagggtctgagaaggccaccatggtcatttcttcccttctgtcagacataattcctcggtttggccttcccacctctatacagtccgatagcagaccggcctttattagtcaaatcagccaagcaggttttcaggctcttggtattcagtgaaacctttatatcccttatggtcctcagtcttcaggaaaggtagaatggactaaaggtcttttaaaaacacacctcaccaagctcagccaccaacttaaaaaggactggacgatacttttaccactttcccttctcagaattcatgcctgtcctcagaatgctacagggtacagcgcatttgagctcctgtatagacgctcctttttattaggccccagtctcattccagacagcagaccaacttggactgtgctccaaaaaacttgtcatccctactatcttctctctagtcatactcctattcaccattctcaactactcatacatgccctgctcttgtttacactgccggcttacactgtttctccaagccatcacagctgatatctcctggtgctatcgccaaaccaccactcttaactcttaaagtaaataaataatctttgctggcaaggctattctgaatctccttaggcattctttaattagatgtcctaggtcctcccaattcttagtcctttaatacctgtttttctccttctcttattccgttcagtttttcaattcatacaaaacagcatccaggccatcaccaataattctacatgacaaatgtctcctctaacaaccccacaatatcaccccttaccacaaaatcttccttcagcttaatctctcccactctaagttcccaagccgcccctaatcctgctcgaagcagccccgagaaacaccgcccgttatctctccataccaccccccaaaattttcgccatcccaacactttaccactatttcattttatttttcttattaatataagaaaacaggaatgtcaggcctctgagcccaagctaagccatcatatcccctgtgacctgcacatacacatccagatggctggttcctgcctttactgatgacattccaccacaaaagaagtgaaaatggcctgttcctgccttaactgatgacattatcttgtgaaattccttctcctggctcaagacctcccctactgagcaccccgtgacaccccccactcctgcctgccagagaacaaccccctttttcctttaaacgcaaatcttatcaaacgggcccacccctatctcccttcgctgactctcttttcggactcggcctgcctgcacccaggtgaaataaacagccttgttgctcacacaaagcctgtttgatggtttcttcacacagacgtgcatgaaa

SEQ ID NO: 40 - DNA, 964 bp, Homo sapiens
gtagggaaaagaaagagagatcagactgttacctgtgtctatgtagaaaaggaagacataagaaactccattttgatctgtaccctgaacaactgttttgccttgagatgtaactttagccccaaccttgagctcacaaaaacatgtgttgtatgcaatcaaggtttaagggatctagggctatgcaggatgtgccttgttaacaaaatgtttacaggcagtatgcttggtaaaagtcatcgccattctccattctcgataaaccaggggcacaatgcactgcggaaagccgcagggacctctgcccaggaaagccgggtattgtccaaggtttctccccactgagatagcctgagatatggcctcatgggacgggaaagacctgacagtcctccagcccaacacccgtgaagggtctgtgctgaggaagattagtaaaagaggaaggcctctgtctcctgcctgcccctgggaactgaatgtctctgtataaaacccgattgtacatttgttctattctgagataggagaaaaaccaccctgtggcaggaggcgagatatgctggcagcaatgctgctctgttactctttactccactgagatgtttgggtggagaaaagcataaatctagcctacgtgcacattcaagcatagtaccttcccttgaacttatttgtgacacagatttctttgctcacatgttttcttgctgaccttttccccactatcaccctgttctcctgccgcattccccttgctgagatagtgaaaatagtaatcaataaatactgagggaactcagagaccggtgccggtgcaggtcctctgtatgctgagcgccggtctcctgggcccactgttctttctctatactttgtctttgagtcttatttctttttctcagtctctcgtcccactcgacgagaaatacccacaggtgtggaggggcaggccgccccttca

SEQ ID NO: 41 - DNA, 3900 bp, Homo sapiens
tgactctctttttggactcagcccacctgcacccaggtgaaataaacagccatgttgctcacacaaagcctgtttggtggtctcttcacacggacgcgcatgaaatttggtgttgtgactcggatcgggggacctcccttgggagatcaatcccctgtcctcctgctctttgctcggtgagaaagatccacctatgacctcaggtcctcagactgaccagcccaagaaacatctcaccaatttcaaatctggtaagtggcctctttttactctcttctccaacttccctcactatccctcaacctctttctcctttcaattttggcgctacacttcaatctctcccttctcttaatttcaattcctttcattttctggtagagacaaaagagacacattttatccgtggacccaaaactccggcgccagtcacggactgggaaggcagccttcccttggtgtttaatcattggagggacgcctctctgattatacacccacgtttcaagggtgtcagaccacgcagggacgcctgccttggtccttcacccttagcggcaagtcccgcttttctggggaaggggcaagtaccccaaccccttctctccttgtctctaccccttctctgcctttcctggggcaggggcaagtacccctcaatcccttctccttcacccttagcggcaagtcccgctttcctaggggcaagaaccccccaatcgcttatttccacaccccaacctcttatctctgtgccccaatcccttatttccgcaccctgacctcttatctctgtgccccaatcccttatttctgtgccccaaccccttctctgcttttctggagggcaagaaccccccaccccttctccgtgtctctactcttttctctgggcttgcctccttcactatgggtaggcttccaccttccattcctccttctcccttagcctgtgttctcaaaaacttaaaacctcttcaactcacacctgacctaaaacctaaatgctttattttcttctgcaatgccgcttgaccccaatacaaactcgacatagttccaaatagctggaaaacggcactttcaatttttccatcctataagatctaaataattcttgtcgtaaaatgggcaaacggtctgaggtgcctgacgtccaggcattcttttacacatctgtcccttcctagtctctgtgcccagtgcaactcgttccaaatcttccttctttccctccctcctgtcccctcagtcccaaccccaagcagtgctgagtctttctaatcttctttttctacagacccatctgacctctcccctccacaccaggccaagctaggtcccaattcttcctcagcctcagcgcctccacactgtaatctttttatcgccaccccccaccccctccaccccgcatcccacacctggtcctgcttacagtttcattctgtgactagccctcccccacctgcccagcaatttactcttaaaaaggtggctggagccaaaggcctagtcagggttaatgctcctttttctttatcctgaatcagatagcgtttaggctctttttcatcaaatataaaaatccagcccacttcatggctcattcggcagcaaccctgagacgctttacagccctagaccctaaaaggtcaaaaggccgtcttattctcaatatacattttattacccaatctgctcccaacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaatgcctgaaccgcagcggccaggcgttcctctagaacctcctcctccaggagcttgctacaagtgccagaaatctgaccaccaaggcaaggaacgcctgcagcccaggattcctcttaagccgtatcccatctgtgcgggaccccactggaaatcggactgttcaactcacctggcagccactcccagagcccctggaactctggcccaaggctctctgactgactccttctcggcttagcggctgaagactgacactgcccgatcgcctcggaagccccgtagaccatcatggacgccgagcttcaggtaactctcacagtggaaggtaagtccgtccccttcttaatcaatacggagcctacccactccacattaccttcttttcaagggcctgtttcccttgcctccataactgttgtgggtattgacagccaggcttctaaacttcttaaaactccccaactctggtgccaacttagacaacactcttttatgcactcttttttagttatctccacctgcccacttctcttattaggccgagatattttaaccaaattatctgcttccctgactattcctggactacagccgcatctcattgctgcccttcgtcccaatccaaaacctcctttgcttcctcctcttgtattcccccaccttaacccacaagtataagagacctctactccctccttggtgactgatcacgcaccccttaccatctcattaaaacctaatcacccttaccccgctcaacgccaatatcctatcccacagcacgctttaaaaggattaaagcctgttatcactcgcctgctacagcacgggcttctaaaacctataaactctccttaccattcccccattttacctgtcctaaaaccaggcaagggttacaagttagttcagaatctgcaccttatcaaccaaattgtttttcctatcccccccgtggtgccaaagccatatactctcctatcctcaatacctccctctgctacccattattctgttctggatctcaaacatgctttctttactatcctttgcaccttcatccagcctctctttgccttcacttagactgaccctgacacccattaggctcagcaaattacctgggctgtactgccgcaaggcttcacagacagcccccattacttcagtcaagcccaaatttcatcctcatctgttacctatctcggcataattctcataaaaacacacgtgctctccctgctgatcgtgtccgattaatctcccaaacctcaatcccttacaaaagaacaactcctttccttcctaggcatggttagtgcggtcagaattcttacacaagagccaggaccacaccgtgtagcctttctgtgcaaacaacttgaccttactgttttagcctagccctcatgtctgcatgcagcggctgccgctgctttaatactgttagaggccctaaaaatcacaaactatgctcaactcactctctacatttctcataacttccaaaatctattttcttcctcatacctgacgcatatactttctgctccccggctccttcagctgtactcactcttaaatcccacaattaccattgttcctggcccggacttcaatctggcctcccacattattcctgataccacacctgacccccatgactgtatctctctgatccacctgatattcaccccatttccccatatttccttctttcctgttcctcaccctgatcacgcttgcctcgtgctatccccaaactgccattcttaactcttgaagtaaataaataatctttgctggcagggctatgctgaatctccttaggcactctctaatcagatgtcctgagttgtcccaattcttagactttttatacctgtttttctccttctgttattccatttagtttttcaattcatacaaaaccatatccaggccatcaccaataattctacacaacaaatgtttcttctaacaaccccacaatatcaccccttaccacaaaatcttccttcagcttaa

SEQ ID NO: 42 - DNA, 752 bp, Homo sapiens
tgcttgaaggcggcatgctcattaagagtcatcaccactccctaatctcaagtacccagggacacaaacactgcagaaggcctcagggacctctgcctaggaaagccaggtattgtccaaggtttctccccatgtgatagtctgaaatatggcctcgtgggaagggaaagacctgaccatcccccagcccgacacccgtaaaggttctgtgctgaggagaattagtaaaagaggaaggaatgcctctttgcagttgagacaagaggaaggcatctatctcctgcgcgtccctgggcaatggaatgtctcagtgtaaaacccaattgtatattccatctactgagataggggaaaaccgcctcaggggtggaggtgggacatgcggtgggcaatactgctctttaaggcattgagatgtttatgtgtatgcatatctaaagcacagcacttaattctttaccttgttcatgatgcagagagctttgttcacgtgtttacctgctgaccttctctccactattatcctatgaccctgccacatccccctctctgagagagaaacacccaataatgatcaataaatactaagggaacttagagtccggcgggatcctccgtatgctgaacgctggtcccctgggcccccttatttctttctctatactttgtctccatgtctttttcttttccaagtctctcgttccacctaacaagaaacacccaaaggtgtggaggggcaacccaccccttca

SEQ ID NO: 43 - DNA, 6648 bp, Homo sapiens
tctcctgctctttgctccgtaagaaagatccacctatgaccttgggtccccagcactttgggaggccgagggaggtggatcaactgaggtcaggagttcgagaccagcctggccaacatggagaaaccctgtctctgcccaaagcacaaaaattagccagccatggtggtgcatgtctgtagtcccagctacaggcagaatcacttgaacctgggaggcagatgttgcagtgagccgagatcgcaccattgcactgcctgggcaagagagtgagactccatctcaaaaacaacaacaacaataaaaaatacaaaaaaaatttggactatttgaaggttcagtgttacctgtgagggactaaattctcacccaaacttcatcataagatgaacaaaataacctagatttagttaagacagcacaagtaccagaccccaagcttgcaaagaaaaaaagactagaaaaatatgcaatctgtaacaacagctatctctaggtggtaggatattaaatgttttcattttgcttcttattttctatattatttacaacaaacgtgaaatatgttcttaaaaaaatcatctgcatataatggtccccacttgtaatcccaggaattcgggaggctgcagcaggagtattgcttcaggccaggagttcaagaccagcctctgggcaacatagtgagactctgtctctaaaaaacaaaaaagtagctgggtagtgttgtttgtctgttgcctcagctactcagaaagctaaggtaaggatggcttgactctgggaagtgcagactacagtgagctgcaatcgtgctgctgtactccagcctgggagacagagcaagacccctgcctcaaaaaaaaaaaagaaagaaaatgaaaaagaaggaagtggggccttcgggaggtaattgtcaggcctctgagcccaagcctgcacatacacatccagatggcctgaagtaactgaagaatcacaaaagaagtgaaaatgagtggttcttgccttaactgatgacattacctcgtgaaacttcttctcctggctcagaagctcccccactgagcaccttgtgaccctcgcccctgccctcaagagaacaaccccgtttgactgtaatttttcactacctacccaaatcctataaaactgccccacccctaactccctttgctgactctcttttcggactcagcctgcctgcacccaggtgattaaaaagctttattgcccacacaaagcctgtttggtggtctcttcacacagacgcacatgacatttggtgctatgactcggatcgggggatctcccttgggagatcaatcccctgtccccctgctctttgctccgtaagaaagatccacctacgacctcgggtcctcagaccaaccagcccaaggaacatctcaccaattttaaatcgggtaagcggcctctttctactctcttctccaacctctctcactatccctcaacttctttctcctttcaattttggtgccacccttcaatctctcccttcccttaatttcagttcctttccctttctggtagagacagaggagacgtgttttatccgtgaacccaaaactccggcaccagtcacagactcgggaagacagtcttcccttggtgtttaatcactgtggggacgcctgcctgattattcacccacatttcagaggtgtgttatcaccacggggacacctgccttgatccttcactttggtggcaagcataacctcccctggggggtaagtatccccctctctccatgtctctaccctctcttttctctaggcttgcctccttcactatgggcaaccttctaccctccattcctccttcttctcccttagcctgtgttctcaagaacttaaaacctcttcaactcacacctaacctaaaacctaaacgccttattttcttctgcaataccgcttgacaatagttccaagtagccagaaaacggcactttcaatttatccatcctacaagatctagataattcttgtagtaaaatgggcaaatggtctgagatgtctgatgtccaggcattcttttacacgtcggtcccttcctaatctctgcttccaatgtgactcatcccaaatctttcttctttctctcttatctgttccttcagtctccaccccaaactctgagttctttaaatcctccttttctgtggacccatctgacctctcccctcctccccaggctgctccttgccaggccaagccaggtcccaattcttccttagcctccgctccccaaccctataattcttctatcacctcccctcctcacccctggtccagcttacagtttcgttctgtgactagccctcccctacctgcccaacaatttcctcttaaagaggtggctggagctaaaggcatagtcaaggttaatgctccttttttctctatcagacctttcccaaatcagttagcacttaggctttttcatcaaatataaaaacccagcccagttcatggctcgtttagcagcaacctttagacgctttactgccctagacccagaggggccagaaggccatcttattctcaatatgcattttattacccaatctgctcccgacattagaaaaagctccaaaaattaaattccggccctcaaaccccacaacaggacttaaataaccttgccttcaaggtgtacaataatagagaagagttgcaattacttgcctctgctgtgagagaaaccccagccacatctccagcacacaagaacttcaaaacacctaagccacagtggccaggcattccttcaggacctcctcccccaggatcttgcttcaagtgctagaaatctggccactgggccaaggaatgcctgcagcccaggattcctcctaggccgtgtcccatctgtgtgggaccccactggaaatcggactgtccaacttgcccgggagctgttcccagagcccctggaactctgccccaaggctctctgactgactccttcccagatcttctcagcttagtggctgaagactgatgctgcctgatggcctcggaagcctcctggaccatcacagacactttgggtaactcttacagtggagggtaagtccgtccccttcttaatacagaggctacccactccacattaccttcttttcaagggcctgtttcccttgcctccataactgttgtgggtattgacggccaggcttctaaacctcttaaaactccccaactctggtgccaacttggacaatattcttttatgcactactttttagttattcccacctgcccagttcccttattaggttgaggcattttaactaaattatctgctttcctgactattcctaggctacagccacacctcattgccgccctttcccccagttcaaagcctccttcacatcctccccttgtgtctccccaccttaatccacaagcataggacacctctactcccttcttggtgaccaatcatgcacccccttaccatcccattaaaaactaatcactcttaccctgcttaaggccaatatcccatcccacagcatactttaaaaggattaaagcctgttatcacttgcctgttacagcatggccttttaaagcctataaactctccttacaattccattttacctgtccaaaaactggacaagtcttacaggttagttcaggatctgtgccttatcagccaaattgttttgcctatccaccctgtggtgccaaacccatatactctcctatcctcaatacgtccctccaccacccattattctgttctggatctcaaaacatgctttttccactattcccctgcactcctcctcccagcccctttgcttttacctggactgaccctgacatccatcagtctcagcaacttacctgggctgtactgctgcaagccttcagggacagcccccattacttcggtcaagccctttctcataatttactctctttctgtccatctacttcacaccttattaagtattttgatgaccttctactatatagcccctcctataaatcttcccaagaggacatcctcctgctcctccaacatctgttatcaaaaggatatctcgtgtcgtcctccaaaacccaaatttcttcctcatctgttacctatctcggcataattcttcataaaaacacacgtgctctccctgctgatcgtgtctggctaatctccaaaaccccaaccccttctacaaaacaacaactccttttcttcctaggcatggttaggtacttccgcctttggatacctagttttaccatcctgactaaaccattatataaactcacaaaaggaaacctagctgacaccataaatcctaaatcctttccctgctcccctttccattccttaaaaaacagccctaaaagctgctcccatactagctctccctaactcatcccaacccttttcattacacacagccgaagtacagggctctgtggtcagaattcttacacaagagccaggactgcgccctgtagcctttctgtccaaacaacttgaccttactgttttagcctagccttcatgtctgcacgcggcagctgctgctgctctaatacttttagaggccctcaaaatcacaaactatgctcaactcactccctacaattctcataacttccatgtagattacaagccgctagcgtgcctcttagaatctctcatttcctttccaccatggacattctaccctcaaggaaatcatttctcagtgttccatctgctattctactactcctcagggattgttcaggccctctcccttccctacacatcaagctcggggatttgcccctgcccaggactggcaaactgacttactcacatgccccgagtcaggaaactaaaatacctcttggtctgggtagacactttcactggatgggtagacgcctttcccacagggtctgagaagtccaccgtggtcatttcttcccttctgtcagacacaattccttggtttggccttcccacctctatacagtccgataatggaccagcctttactagtcaaatcacccaagcagtttctcaggttcttggtattcagtagaaccttccccttaccgtcctcaatcttcggaaaaggtaaaacggactaatgatcttttaaaaacacacctcgccaagctcagcctccaacttaaaaaggactggacaatacttttaccacttgcccttctcagaattcgggcctgtcctcgggacgctacagggtacagcccatttgagctcctatggatgctcctttttattaggccccagtctcattccagacaccagcctaacttggactgtaccccaaaaacttgtcatccctactatcttctgtctagtcatactcctattcaccattctcaactactcataaatgccctgcccttgtttccactgccggtttacacttttccttcaaaccatcataactgataccttctggttttacctcaaaccaccacccttaagtctctcttaaagtggatagatgatcttgctggcagggtacactccaatactttcaccttgatgaagtcctattctttactttcatactcactcttattcttgttcccgttcttatgccaccctctacctctccccagctatctccaccacactatcaatctcactcactctctcctagccgtttctaatccttctttaacaaacaattgctggctttgtatttctctttcctccaaaatcgtggaggactcgttagtcactgctaaaaaaaaaggggactctgtatattaaacgaagagtgttgtttttacctaaatcaatctggcctggtatatgacaacataaaaaaactcaaagatagagcccaaaaacttgccaaccaagcaagtaattatgctgaacccccttgggcactctctagttggatgtcctgggtcctcccaattcttaagtcctttaatacctgtttttctccttctcttatttggaccttgcgtcttctgtttagtttctcaattcatacaaaaccgtatccaggccatcaccaatcattctatacaacaaatgctccttctaacaaccccacaatatcacctcttaccacagaatcttccttcagcttaatctctcccactctaggttcccacgccgccccaatcctgctcgaagcagccctgagaaacgtcgcccattatctttccataccacccccaaaaattttcagggccccaacactttaccactattttatttttcttattaatgtaagaagacaggaatgtcaggcctctgagcccaagcctgaacgtatacatccagatggcctgaagtaactgaagaatcacaaaagaagtgaaaatggccggttcctgctttaactgatgacaataccttgtgaattgaattccttctcctggctcagaagctccccgactgagcaccttgtgacccccgcccctgcccgcaagagaacaatcccctttgactgtaatcttccccactacctacccaaatcctataaaactaccccacccctaactccctctgctctctttttggactcagcccgcctgcacccaggtgaataaaaagcttcattgctctctccaagcctgtttggtggtctcttcacacggacgcgtgtga

SEQ ID NO: 44 - DNA, 539 bp, Homo sapiens
aagaaatagtcaatcatctgtcgcctgagagcacagggggagggacaatgatagggatataaacccaggcattcgagccattagtggcaaccgctttcgggtcccctcccgttatatgggagctctgttttcactctattacatcttacaactgcacagtcttctccgccgtgtttgttccagctcgagctgagctttcactcaccatccaccactgctgattgccgccgtcgcagacccgccactaacttccacccctccggatccggcagggtgtccgctgcgtttctgatccagcgaggcacccattgctgctcccgatggggctagaggctcaccattgttcctgtgcggctcagattagggttcgtcctaatcaagctgaacactagtcgctggggtccgcggttctcctccgtgaccaacggcttctaatagagctaaaacattgactgcatggccgaggttccattccttggaatccctgaggccaagaaccccaggtcagagaacaaaaggcttgccgccatcttgggagc

SEQ ID NO: 45 - DNA, 6087 bp, Homo sapiens
gtcagggctctgagcccaagctaagccatcatatcctctgtgacctgcacgtatacatccagatggccggttcctgccttaactgatgacattccaccacaaaagaagtgaaaatggcctgttcctgcgttaactgatgacattgtcttgtgaaattccttctcctggctcatcctggctcaaaagctcccctactgaacaccttgtgaccccccactcctgcccaccagagaacaactccctttgactgtaattttcctttacctacccaaatcttataaaacggccccacccctgtctcctttcactgactctctttttggactcagcccgcctgcacccaggtgaaataaacagccatgttgctcacacaaagcctgtttggtggtctcttcacacggacacgcatgaaatttggtgctgtgactcagatcaggggacctcctttgggagatcaatcctctgtcctcttgctctttgctctgtgtaaaagatccacctacgacctcaggtcctcagacccaccagcccaaggaacatctcaccaattttaaatcgggtaagcggcctcttcttactctcttctccaacctctctcactaaccgtcagccactttctcctttccactcttctgtctctcccttctcttaatttcaattcctttcattttctggtagagacaaaggagacacattttatctgcgaacccaaaactccggcgccggtcatgggctgggaaggcagccttcccttggtgtttaatcattgcagggatgcctctctgattattcacccatgtttcagaggtgtcagaccatgcagggatgcctgccttggtccttcacccttagcggcaagtcccattttttggggggagaggcaagtaccccaaccccttctctccatgtctctaccccttctccacctttctggggggcaagaaacccccaaccccttctccttcacccttagtggcaagtcctgcttttctgggggaggggcaagtaccccaacctcgtatctctgcaccccatcccttatttccatgccctgacctcttatatgtctgcaccctgatcccttatttccatgccccaacctcttatatctctgtgccctgatcccttatttccatgccccgacctcatatctctgtgccccaacccctttcccgcttttctggagggtaagaacccccgaaccccttccctccgtgtctctactcttacttttctttaaacttgcctccttcactataggcaaccttccatcctccattcctccttcttctcccttagcctgtgttcttaagaacataaaacctcttcaactctcaccggacctaaaacctaaatgccttattttcttctacaatgccacatgaccccaatacaaactcaacagtggttctaaatggccagaaaatggcactttcgatttctccatcctacaagatctaaataatttttgtcaaaaaataggcaaatggtctgaggtgcctgatgcccaggaactcttttacacatagtccctctctagtctctgttcccaatgcaactagtcccaaatcttccttctttccctccctcctgtcccctcagtccaaaccccaagtgtcgctgagtctttgtaatcttccttttctacagacccatctgacctctcccctcctccccaggccaagctaggtcccaattcttcctcagcctctgctcctccaccctataatctttttatcacctcccctcctcacacctggtctggcttacagtttcattccatgactagccctcccccacctgcccagcaatttactcttaaaaaggtggctggagctaaaggcatagtcaaggttaatgctcctttttctttatcccaaattagttagatttaggctctttttcatcaaatataaaaatccagcccagttcatggctcatttggcagccaccctgaaacgctttacagccctagaccctaaaaagtcaaaaggctgtcttattctcaatatacattttattacccaatctgctcctgacattaaataaaactccaaaaattaaattccagccctgaaaccccacaacaggatttaattaacctcaccttcaaggtgtacaataatagaggcagccaagtagcaacatatttctgagttgcaattccttgcctccactgtgagacaaaccccagccacatctccagcacacaagaacttccaaacgcctaaaccacagtggccaggtgttcctccagaaccaccttccccaggagcttgctataagtgccagaaatctggacaccaggccaaggaatgcccacagcccaggattcctcctaagccatgtcccatctgtgcgggaccccactggaaatcagactgttcaactcacatggcagccactcccagagcccctggaactctggcccaaggctctctgactgactccttcccagatcttcttggcttagcagctgaagactgacagtgcccgatcgcctcagaagcctacagaaccatcacggacaatctaggtaactctcacagtggaaggtaagtccgtccccttctcaatcaatatggaggctacccactccacattaccttcttttcaagggcctgtttcccttgcctccataactgctgtaggtattgatggccaggcttctaaacctcttaaaactccccaactctggtgccaacttagacaacactcttttaagcactccttttaagttatccccacctgcccagttccgttattaggccgagacactttaactaaattatctgcttccctgactattcctggactacagctacatctcattgccgcccttcttcccaatccaaagccacatttgtgtcctcctcttgtatccccccaacttaacccacaagtataagatacctctactccctccttggcaaccgatcatccaccccttaccgtctcattaaaacctaatcacccttaccccgctcaataccaatatcctatcccataccatgctttgaaaggataaaggcctgttatcactcacctgctacagcatggccttttaaagcctataaactctccttacaattcccccattttacctgtcctaaaaccagacaagccttacaagttagtttaggatctatgccttatcaaccaaattgttttgcttatccaccctgtagtgcccaacccgtacactcttttgtcctcaataccttcctccacaactcactattccgttcttgatcttaaagatggttttttcactattcccctgaacctctcgtcccagcctctctttgctttcatctggactgaccctgacacccatcagccccagcagcttacctgggctgtgctgccacaaggtttcagggacagtccttattacttcagccaagctctttctcatgatttattttctttccacccctctgcttctcaccttattcagtatattgatgaccttctttgtagcccctcctttgaatcttctcaacaagacacacttctgctccttcagcatttattctccaaaggatatcgggtatccccctccaaagctcaaatttcttctgcatccgttacctcggcataattcttcacaaaaacacacgtgctctccctgccgatcatgtctgactgatctctcaaaccccaaccccttctacaaaacaactactcctttccttcctgggcgtgattggatacttccgcctttggatacctggttttgccatcctaacaaaaccattatataaactcacaaaaggaaacctagctgaccccatagatcctaaatcctttccccactcctctttccgttccttgaagacagctttagagactgcccccactctagctctccctgactcatcccaacccttttcattacacacagccaaagtgcagggctgtgcagtcagaattcttacacaaggactgggatcgtgtcctgtaggctttttgtccaaacaacttgaccttactgttttaggctggccatcatgtctctgtgcagcggctgatgccaccctaataattttagaggcccttaaaatcacaaactatgctcaactcactctctacagctctcataatttccaaaatctattttcttcctcacacctgacgcacatactttctgctccctggctccttcagctatactcactctttgttgagtctcccacaattaccattgttcctggcccagacttcaatccagcctcccacattattccggataccacacctgaccctcataactgcaactctctgatccacctgacgttcaccacatttccccacatttctttcttccctgtttctcaccctgatcacagttggtttattgatggcagttccaccaggcctaatcaccacacaacagcaaaggcaggctatgctatagtacaagccactagcccacctcttaaaacctctcatttcctttccattgtggaaatctatcctcaaggaaataacttctcaatgttccatctgctattctactacttctcagggattattcaggccccctcccttccctacacatcaagcttgaggatttgcccccacccaggactggcaaattagctttactcaacatgccccgagtcagataactaaaatacctcttagtctaggtagacaatttcactggataagtagaggcctttcctgcaggtctgagaaggccaccacagtcatttcttcccttctgtcagacatcctcagtttagccttcccacctctatacagtctgataacggaccagcctttattagtcaaatcagccaagcattttttcaggctctcagtattcagtgaaacctttatatcccttatggtcctccgtcttcaagaaaagtagaatggactaaaggtcttttaaaaacacacctcaccaagctcagccgccaacttaaaaaggactggacaatacttttaccactttcccttctcagaattcaggcctgtcctcagaatgctacaaggtacagcccatttaagctcctgtatagacactcctttttattaggtaccagtctcattccagacaccagaccaacttaaactgtgacccaaaaaacttgtcatccctattattttctgtgtagtcatactcttattcacctgttctcaactactcgtacatgccctgctcttgtttacactgccagtttacactgtttctccaagccatcacagctgatatctcctggtgctatccccaaaccaccactcttaactcttaaagtaaataaacaatctttactggcaaggctatgctgagtctccttaggcactctctaattacatgtcctaggtcctcccaattcttggtcctttaatacctgtttttctccttctcttattccatttagtttttcaattcaaacaaaactgtatccaggccatcaccaataattctaaatgacaaatgtttcttctaacaaccccacgacatcaccacttaccacaaaatcttccttcagcttaatctctcccactctaggttcccacgccgcccctaatcctgctcaaagcagccctgagaaacatcgcccattatctctccataccaccccaaaaaaattttcaccatcccaaccctttaccactatttcattttatttttcttattaatataagaagacaggaatgtcaggcctctgagcccaagctaagccatcatatcccctgtgacctgcaggtacacacccagatggctggttcctgccttaactgatgacattccaccacaaaagaagtgaaaatggcctgtttctgccttaactgatgacattgtcttgtgaaattccttctcctggctcatcctggctcaaaatctcccccactgagtaccttgtgacccccactcctgcccgccagagaacaactccctttgactgtaattttcctttacctacccaaatcttataaaatggccccacctctatctcccttctctgactctcttttcgaactcagcccgcctgcacccaggtgaaataaacagccatgttgctcacacaaagcctgtttggtggtctcttcacacagacgtgcatgaaa

SEQ ID NO: 46 - DNA, 5854 bp, Homo sapiens
gtcaggcctctgagcccaagccaagccatcgcatcccctgtgacttgcacatatacgcccagatggcctgaagtaactgaagaagcacaaaagaagtgaaaaggccctgtcccgccttaactgatgacattccaccattatgatttgttcctgccccaccttaactgagtgattaaccctgtgaatttccttctcctggctcagaagctcccccactgagcaccttgtgacccctgcccctgcccaccagagaacaaccccctttgactgtaattttccattaccttcccaaatcctatgaaacggccccattcctatctcccttcactgactctcttttcggactcagcccgcctgcaccgaggtgaaataaacagccatgttgctcacacaaagcctgtttggtggtctcttcacacggacttgagtgaatttggtgctgtgactcggactgggggacctccgttgggagatcaatcccccgtcctcctgctctttactccatgagaaagatccacctatgacctcaggtcctcagaccaaccagcccaagaaacatctcaccaatttcaaatccagtaagtggcctctttttactctcttctccatcttccctcactatccctcaacctctttctcccttcaatcttggggtcacacttcaatctctcccttctcttaatttcaattcctttcattttctggtagagacaaaggagacacgttttatccatggacccaaaactccggcgccggtcacggactgggaaggcagacttcccttggtgtttaatcattgcagggacacctctctgattattcacccacatttcaaaggtgtcagaccacacagggatgcctgccttggtccttcacccttcgcggcaagtcctgcttttctgggggaggggcaagtacccctcaaccccttctccttcacccttagcggcaagtcccgcttttctggaggaggggcaagtaccccaaccccttctctccgtgtctctaccccttctctgattttctggggcaagggcaagaacccctcaaccccttctccttcccctcagtggcaagtcccgcttttctaggggaggggcaagtaccccaaccccttctctccgtgtctctaccccttctctgcttttctggaggagaggcaagtaccccaacctcatatctctgcaccccgatcccttatttccacaccctgacctcgtatctctgcgccctgaccccttctctgcttttctggaggacaagaaacccccaccccttctctgtgtctctactcttttctctgggcttgcctccttcactatgggcaagcttccaccttccattcctccttctcccttagcctgtgttcttaagaacttaaaacgtcttcaactgtcacctcacctaaaatctaagtgtcttattttcttctgcaatgccgcttgaccccaatacaaactcgacagtagttccaaatagccggaaaacagcactttcaatttttccatcctacaagatctaaataattcttgttgtaaaatgggcaaatggtctgaggtggctgacatccaggcattctttcacacatcagtcccttcctagtctctgtgcccagtgcaactcatcccaaatcttccttctttccctcccgcctgtcccctcagtcccaaccccaagcgtcgctgagtctttctaatcttccttttctacagacccatctgacctctcccctcctcaccaggccaagctaggtcccgattcttcctcagcctccgctcctccaccctataatctttttatcgcctcccctcctcacacctggtccagcttacaatttcgttccatgagtatccctcccccacctgcccagcaatttactcttaaaaacgtggctggagccaaaggcatagtcaaggttaatgctcctttttctttattccaaatcagaagcgtttaggctctttttcatcaaatataaaaacccagcccagttcatggctcattcggcagcaaccctgagacgctttacagccctagaccctaaaaggtcaaaaggccatcttattctcaatatatattttattacccaatccgctcccgacattaaataaaactcccaaagttggaatctggccctcaaaccccacaacaggacttaattaacctcaccttcaaggtgtacaataataaaaaaaaagttgcaattccttgcctctactgtgagacaaaccccagccacatctccagcacacaagaacttccaaacgcctgaaccgcagcagccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcaactcacctggcagccactcccagagcccctggaactctggcccaaggctctctgactgactccttctcggcttagcagctgaagactgacactgcccgaccacctcgaaagccccgtagaccatcacagacgccgagcttcaagtaactctcacagtgcaaggtaagtccgtccccttaatcaatatggaggctacccactccacattaccttcttttcaaggtcctgtttcccttgcctccgtaactgttgtaggtattgacggccaggcttctaaacctcttaaaactccccaactctggtgccaacttagacaatactcttttaagcactccttttagttatccccacctgcccagttcccttattaggccgagacactttaaattatctgcttccctgactattcctggattacagctgcatctcattgccgcccttcttcccaatccaaagcctcctttgcatcctcctcttgtattcccccaccttaacccacaagtataagatacctctactccctccttggcgactgatcatgcaccccttaccatctccttaaaacctaatcacccttaccccactcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctatgccttatcaaccaaattgttttgcctatccaccctatggtgccaaacccatatactctcctatcctcgatacctccctccacaatccattattctgttctggatctcaaaaatgctttctttactattcctttgcacccatcatcccagcctctctttgctttcacttggactgaccctaacacccattaggctcagcaaattacctgggctgtactgccccaaggcctcacagacagcccccattacttcagtcaagcccaaatttcatcctcatctgttacctatctcagcataattattcataaaaacacaggtgttctccctgttgattgtgtccgattaatctcccaaacctcaattccttacaaaacaacaactcctttccttcctaggcatggttaatgtggtcagaattcttacacaagagccaggaccgcaccctatagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgatgcatatactttctgctccccggctccttcagctgtactcactctttgttaagtcccacaattaccattgttcctggcccggacttcaatctggcctcccacattattcctgataccacacctgacccccatgactgtatctctctgatccacctgacattcaccgcatttccccgtatttccttctttcctgttcctcaccctgatcacgcttgatttattgatggcagttccaccaggcctaattgccacacaccagcaaaggcaggctatgctatagtacaagccactagcccacctcttagaacctctcatttcctttccattgtagaaatctatcctcaaggaaataacttctcagtgttccatctgctattctactactcctcaaggattattcaggccccctcccttccctacacatcaagcccggggatttgcccctgcccaggactagcaaatttgctattctactactcctcaaggattattcaggccccctcccttccctacacatcaagttcaaggatttgcccctgcccaggactgtcatattagctttactcaacatgccccgagtcacaaaacctaaaatacctcttagtctaagtagacgctttcactagataggtagagacctttcctacagggtctgaggccaccgcagtcatttcttcccttctgtcagacataattcctcagtttagccttcccacctctatacagtctgataacagaccagtctttattagtcaaatcagccaagcagtttttcaggctcttaatattcagtgaaacctttatatcccttatagtcctctgtctttaagaaaagtagaacagactaaaggtcttttaaaaacacacctcaccaagctcagccaccaacttaaaaagaactggacaatacttttaccactttcccttctcagaagtcagacctgtcctcagaatgctacaaggtacagcccatttaagttcctgtatagatgctcctttttattaggccccagtctcattccagacactggatcaacttagactgtgcccccaaaaaaacttgtcatccctactattttctgtctagtcatactcctattctccattctcaactactcatacatgccctgctcttgtttacactgccagtttacactgtttctccaagccatcacagctgatatctcctcgtgctatccccaaaccgccactcttaactcttgaagtaaataaataatctttgctggcaggactatgctgaatctccttaggcactctctaatcagatgtcctaggtcctcccaattcttggaccttttatacctgtttttctccttctcttattccatttagtttttcaattcatacaaaactgtatccaggccatcaccaataattcgaaatgacaaatgtttcttctaacaaccccacaatatcacccctttctacaaaatcttccttcagcttaatctctcccactctaggttcccacgctgccccaatcccacttgaagcagccctgagaaacatcgtccattctctctccataccaacccccaaaaattttcgccaccccaagacttcaacactattttatttttcttattaatataagaaggcaggaatgtcaggcctctgagcccaagccaagccatcgcatcccctgtgacttgcacatatacacccagatggcctgaagtaactgaagaatcataaaagaagtgaaaaggccctgccccgccttaactgatgatattccaccattgtgatttgttcctgccccaccttaactgagtgattaaccctgtgaatttccttctcctggctcagaagctcccccactgagcaccttgtgacccctgcccctgcccaccagagaacaaccccctttgactgtaattttccattaccttcccaaatcctataaaacggccccacccctatctcccttcacttgactcttttcggactcagtccacctgcaccgaggtgaaataaacagccatgttgctcacacaaagcctgtttggtggtctcttcacacggactcgagtgaaa

SEQ ID NO: 47 - DNA, 3865 bp, Homo sapiens
gtcaggcctctgagcccaagccaagccatcgcatcccctgtgacctgcacgtatacacccagatggcctgaagtaactgaagaatcacaaaagaagtgaatatgccctgccccaccttaactgattacattccaccacaaaagaagtgtaaatggccggtccttgccttaactgatgacattaccttgtgaaagtccttctcccggctcatcctggcccaaaatcacccccactgagcaccttgcgacccccactcctgcctgccagagaacaaatcccctttgactgtaattttcctttacctacccaaatcctataaaatggctccacccttatctcccttcgctgactctcttttctgactcaacccacctgcacacaggtgattaaaagctttattgctcacacaaagcctgtttggtggtctcttcacatggacacgcatgaaatttggtgccatgactcggatcgggggacctcccttgggagctcaatcccctgtcctcctgttctttgctccgtgagaaagatccacctatgacctcaggtcctcagaccagccagcctaaggaacatctcaccgattttaaatcaggtaagcggcctcttcttactctcttctccaacctctctcactgtccctcaaccactttctcctttccactcttcaatctctcccttctcttaatttcaattcctttcattttctgggagagacaaaggagacacattttatccatggacccaaaactccggtgccggtcacggactgggaaggcagccttcccttggtgtttaatcattgcagggacacctctctgattatacacccatgtttcaaggatgtcagaccacgcagggacgcctgccttggtccttcacccttagcggcaagtcccgcttttctggagaagggtcaagtaccccaaccccttctgtccttgtctctaccccttctctgcttttctggggacagggcaagtaccccaaccccttctctccttgtctctaccccttctctgcttttctgggagaggggcaagtacccctcaaccccttctccttcacccttagtggcaagtcctgcttttctactgggcaagaatccccaatcccttatttctgtgccccaacctcttatctctgtgccccaatctcttatttccgtgcaacaacctcttatctctgtgccccaatcccttatttccgtgcaacaacctcttatatctctgcacctcaatcccttatttccacaccccgacctcttatctctgtgccccaatcccttatttccatgccctgaccccttatttctgtgccccatcccttatttccctgccccgacctcttatctctgcgccccaaccccttttcccacttttctggaaggtaagaacctccgaaccccttccctccatttctctactctctcttttctctaggcttgcttccttcactatgggcaaccttccaccctccattcctccttctactcccttggcctgtgtgctcaaaaacttaaaacctcttcaactcacacctgacctgaaacctaaatgccttattttcttctgcaatgccgcttgaccccaatacaaatttgacagtagttccaaatagccagaaaatggcactttgaatttttccatcctgcaagatctaaatatttcttgtcgtaaaataggcaaacggtctgaggtgcctgatgtccaggcattcttttacacatcagtcccttcctagtctctgtgcccagtgcaacttgtcccaaatcttccttctttccctcccgcctgtcccctcagtaccaaccccaagcgtccctgagtctttctaatcttccttttctacagacccatctgacctctcccttcctccccaggctgctcctcgccaggccgagccaggtcccaattcttcctcagcctctgctcctccaccctgtaatccttttatcacctcccctcctcacacctggtccagctttcagtttcattctgccacttgccctcccgcacctgcccagcaatttacccttaaaaaggtggctggagccaaaggcgtagtcaaggttaaagctcctttttctttatcctaaatcagaagcatttaggctctttttcatcaaatataaaaatccagccccattcatggctcgttcggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacattgccttcaaggcgtacaataatataaaaaagttgcaattccttgcctccactgtgagacaaaccccagccacatctccagcacacaagaacttccaaacgcctgaaccgcagcagccaggcgttcctccagaacctccttccccaggagcttgctacacgtgccggaaatctggccactgggccaaggaatgtccgcagcccaggattcctcctaaaccgcgtcccatctgtgcgggaccccactgaaaatcggactgttcaactcacctggcagccactcccagagcccctggaactctggcccaaggctctctgactgactccttcccagatcttcttggcttagcggctgaagactgacactgcccgatcacctcggaagccccctcgaccatcacggacgccgagcttcaggtaactctcacagtggaaggtaagcccgtccccttcttaatcaatatggaggctacccactccacattaccttcttttcaagggcctgtttcccttgcctccataactgttgtgggtattgacggccaggcttctaaacctcttaaaactccccaactctggcgccagcttagacaatgctcttttaagcactcctttttagttatccccacctgcccagttctcttattaggccaagacacttcaactaaattatctgcttccctgactattcctggactacagctacatctcattgccgcccctcctcccaatccaaagcctcctttgcgtcctcctcttgtatccccccaccttaacccacaagtatacctctactccctccttggtgaccgatcatgcaccccttaccatctcattaaaacctaatcacccttaccccactcaacgccaatattcccatcccgcagcatgctttaaaaagattaaagcctgttatcactcgcctgctacagcatgaccttttaaagcctataaactatccttacaattcccccattttacctgtcctaaagccagacaagccttacaagttagttcaggatctatgccttatcaaccaaattgtttcgcctatccaccctgtggtgccaaacccctacactcttgtcctcaataccctcctccacaactcactgttccgtgcttgatcttaaagatgcttttttcactattcccctgcacccctcgtcccagcctctcttcgccttcacttagactgaccctgacacccattaggctcagcaaattaccaaggctgtactgccgcaaggcttcatagacagcccccattacttcagtcaagcccaaatttcatcctcatctgttacctatctcggcataattctcataaaaacatacgtgctttccctgctgatcgtgtccgattaatctcccaaacctcaatcccttacaaaacaataactcctttccttcctaggcatatagttagtgcgatcagaattcttatgcaacagccaggactgcaccctgtagcctttctgtgcaaacaacttgaccttactgttttagcctagccctgatgtctgcatgcagcggctgccgctg

SEQ ID NO: 48 - DNA, 6146 bp, Homo sapiens
gtcaggcctctgagcccaagctaagccatcatatcccctgtgacctgcacgtacacacccagatggccagttcctgccttaactgatgacattccaccacagaagaagtgaaaatggcctgttcctgccttaactgatgacactgtcttgtgaaattccttctcctggctcatcctggctcagaagctcccctactgagcaccttgtgacccccactctgcctgccagagaacccccatttgactgtaattttcctttatctacccaaatcctataaaacggccccacccctatctcccttctctgactctcttttcagactcagccagcctgcacccaggtgattaaaagctttattgctcacacaaagcctgtttggtgatttcttcacacagactcacatgaaatttggtgccatgactcggatcgggggacctcccttgggagatcaatcccctgtcctcctgttctttgctccgtgaaaaagatccacctacgacctcaggtcctcagacccaccagcccaaggaacatctcaccaattttaaatcaggtaagtggcctcttcttactctcttctccaacctctctcactatccctcaaccactttctcctttccactcttcagtctctcccttctcttaatttcaattcctttcattttctggtagagacaaaggagacacgttttgtctgtggacccaaaactccggcgccggtcacggactgggaaggcagccttcccttggtgtttaatcattgcagggacacctctctgattattcacccacgtttcagaggtgtcagaccacgcaaggatgcctgccttggtccttcacccttagcggcaagtcccgcttttctaggggaggggcaagtaccccaaccccttctctccatgtctctaccccttctctgcctttctggggggcaagaaacccccaatcccttctccttcacccttagtggcaagtcccgcttttctggtggagaggcaagtaccccaacctcatatctctgtgccccgatcccttatttctgtgccccgacctcttatatctctgcgccctgatcccttatttctgcggcccgacctcttatatctctgtgccctgatcccttatttccgctccccaccctcttatatctctgtctcctgatcccttatttccatgctccgacctcatatctctgcgccctgacccctttcctgcttttctggagggtaagaacccccgaaccccttccctccatgtctccactctctcttttctctgggcttgcttccttcactatgggcaaccttccaccttccattcctccttcttctcccttagcctgtgttctcaaaaacttaaaacctcttcaactcacacctgacctaaaacctaaatgccttattttcttctgcaatgccacttgaccccaatacaaactcgacagtagttccaaatagccagaaaacagcactttcaatttttccatcctgcaagatctaaataattcttgtcctaaaatgggcaaacggtctgaggtgcctgatgtccaggcattcttttacacatcggtcccttcctagtctctgtgcccagtgaaactcatcccaaatcttccttctttccctctcgcctgtcccctcagtcccaaccccaagcgtcgctgagtctttctaatcttccttttctacagacccatctgacctctcccctcctccccaggctgctcctcgccaggccgagctaggtcccaattcttcctcagcctccgctcctccaccctataatctttttatcacctcccctcctcatacccggtccggtttacagtttcattccgtgagtagccctcccccacctgcccagcaatttcctcttaaaaaggtggctgaagctaaaggcatagtcaaggttaatgctcctttttcttcatcagacctctcccaaatcctgagcatttaggctctttcatcaaatatgaaaaacccagcccagttcatggcttgttcagcagcaaccctgagacgctttacagccctagaccctgaaaggtcaaaaggccgtcttattctcaatatacattttattacccaatctgctcctgacattaaataaaactccaaaaattaaattccggccctgaaaccccacaacagggcttaattaacctcaccttcaaggtgtacaataatagagacagccaagtagcaacatatttctgagttgcaattccttgcctccactgtgagacaaaccccagccacatctccagcacacaagaacttccaaacacctaaactgcagtggccaggtgttcctccagaaccgccttccccaggagcttgctataagtgccagaaatctggacaccaggccaaggaatgcccacagcccgggattcctcctaagccatgtcccatctgtgcgggaccccactggaaattggactgttcaactcacctggcagccactcccagagcccctggaactctggcccaaggctctttgactgactgcttcccagatctcggcttagcagctgaagactgccactgccagatcgcctcgaagcctacaagaccattacagacactctgggtaactctcacagtggaaagtaagtccgtccccttcttaatcaatacggaggctacccaccccacattaccttattttcaaaggcctgtttcccttgcttccataactgttgtgggtattgatggccaggcttttaaacctgttaaaactccccaactctggtgccaacttagacaatattcttttaagcactccttttcagttatccccacctgcccagttcccttattaggccgagatattttaaccaaattatctgcttccctgactattcctggactacagccgcatctcactgctgcccttctccccaacccaaagcctccttcgcgtcttcctctcatatccccccaccttaacccacaagtatgggacatctctactccttccctggcaacagatcacatgcccattaccatcccattataacctaatcacccttaccccgctcaacaccaatatcccatcccatagcacgctttaaaaggattaaagcctgttatcactcgcctgctacagcatgggcttctaaaacctataaactctccttacaattcccccattttacctgtcctaaaaccgcacaagtcttacaggttagttcaggatctgcgccttatcacccaaattgttttgcctatccaccctgcggtgcccaacccgtacactcttttgtcctcaataccttcctccacaactcactattccattcttgatcttaaagatgcttttttcactattccccttcacccctcgtcccagcctctctttgctttcacctggactgaccctgacacccatcagtcccagcagcttacctgggctgtgctgccgcaaggtttcagggacagccctcattacttcagccaagctctttctcatgatttactttctttctacccctccgcttctcaccttattcaatatattgatgaccttcttctttgtagcccctcctttgaatcttctcaacaagacacacttctgctccttcagcatttattctccaaaggatatcgggtatccctctccaaagctcaaatttcttctccatccgttacctaccttggcataattcttcataaaaatacacgtgctctccctgctgatcgtgttggactaatctctcaaaccccaaccccttctacaaaataacaactcctttccttcctgggcatggttggatattttcgcctttagatacctggttttgccatcctaacaaaaccattatataaactcacaaaaggaaacctagctgaccccatagatcctaaatcctttccccactcctctttctgttccttgaagacagctttagagactgcccccactctagctctccctgactcatcccaacccttttcattacacacagccgaagtgaagggccgtgcagtcagaattcttacacaaggaccgggatcacgtcctgtagcctttttgctcaaacaacttgactttactgttttaggctggccatcatgtctccgtgcagcggctgctgccgccctaatacttttagaggcccttaaaatcacaaactatgctcaactcactctctacagctctcataatttccaaaatctattttcttcctcacacctgacacatacactttctgctccccagctccttcagcagtactcactctttgttgagtctcccacaattaccattgttcctggcccggacttcaatccagcctcccacagtattgctgataccacacctgaccctcatgactgcatctctctgatccacctgacgttcaccccatttccccacatttccttcttccctgtttctcaccctgatcacagttggtttattgatggcagttccaccaggcctaatcgccactcaccagcaaaggcaggctatgctatagtacaagccactagcctgcctcttaaaacctctcatttcctttccattgtggaaatctatcctcaaggaaataacttctcaatgttccatctgctattctactactcctcagggattattcaggccccctcccttccctacacatcaagctcgaggatttgcccccacccaggactggcaaattagctttactcaacatgccccgagtcagataactaaaatacctcttagtctaggtagatactttcactggataggtacaggcctttcctacagggtctgagaaggccactgcagtcatttcttcccttctgtcagacataattcctcagtttagccttcccacctctatacagtctgacaacggaccagcctttattagtcaaatcagacaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttcccttctcagaagtcagacctgtcctcagaatgccacaaggtacagtccatttgagctcctgtatggacactcctttttattaggccccagtctcattccagacaccagaccaacttagactgtgccccaaaaaaacttgtcatccctactatcttctgtctagtcatactcctattcactgttctcaactactcatacatgccctgctcttgtttacactgccggtttacactgtttctccaagccatcacagctgatatctcctggtactgtccccaaactgccactgtaaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaactgtatccaggccatctccaataattctacacgacaaatgtttcttctaacaaccccacgacatcacctcttaccacaaaatcttccttcagcttaatctctcccactctaggttcccacgctgcctctaataccgcttgcagcagccctgagaaacatcgcccattatctctccacaccacccccaaaaattttcaccatcccaacactttaccactatttcattttatttttcttattaacataagaagacaggaatgtcaggcctctgagcccaagctaagccatcatatcccctgtgacctgcaggtacacacccagatggctggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactttgcccgccagagaacaacccccctttgactgtaattttcctttatctacccaaatcctataaaatggctatacccttatctcctttctctgactctcttttcgaactcagcctgcctgcacccaggtgaaataaacagccatgttgctcacacaaagcctgtttggtggtctcttcacactga

SEQ ID NO: 49 - DNA, 4578 bp, Homo sapiens
gtcaggcctctgagcctaagctaagccatcatatcccctgtgacctgcccgtacacatccagatggccggttccagccttaactgatgacattccaccacaaaagtgaaaatgacctgttcctgccttaactgatgacattatcttgtgaaattccttctcctggctcatcctggctcaaaagctcccctactgagcaccctgtgacccccacttctgcccgccagagaacaacccccctttttcctttacctacccaaatcctataaaatggccccaccccatctcccttcactgactctctttttagactcagcccgcctgcacccaggtgattaaaagctttattgctcacacaaagcctgtttagtagtctcttcacacggacacacatgaaatttggtgctgtgactcggattgggggacctcccttgggagatcaatcccctgtcctcctgctctttgctctgtgagaaagatccacctatcaggtcctcataccgaccagcccaagaaacatctcactaatttcaaatccggtaagtggcctctttttactctcttctccaacctctctcactatccctcaatctctttcgcctttcaatcttggcgccacacttcaatctctcccttctcttaatttcaattactttcattttctggcagagacaaaggagacatgttttattcgtctccttttagccctcccccacctgcccagcaatttactcttaaaaaggtggctggagccaaaggcatagtcaaggttaatgctcctttttctttatcccaaatcagatagcgtttaggctctttatcatcaaatataaaaacccagcccagttcatggctcgtttggcagcaaccctgagatgctttacagccctagaccctaagaagtcaaaaggccgtcttattctcaatatacattttattacccaatctgctcccaacattaaataaaactccaaaaattaaattctgaccctcaaactccacaacaggacttaattaaccttgccttcaaagtgtacaatcacagaaaaaagttgcaattccttgcctccactgtgagacaaaccccagccatatctccagcacacaagaacttccaaacgcctgaactgcagcggccaggcattcctccagaacctcctcccccaggagcttgctacaagtgccaaaaatctggccaccaagccaaagaatagccgcagcccaggattcctcctaagccgtatcccatttgtgcaggatcccactagaaatcggactgttcaactcacctggcagccactcccagagcccctggaactctggcccaaggctctctgactgactccttcccagatcttctcggcttagcggctgaagactgacgctgcccgatcgcctcagaagccccctagaccatcacggatgccgagcttcaggtaactctcacagtggaaggtaagtccgtccccttcttaatcaatacggaggctacccactccacattaccttcttttcaaaggcctgtttcccttgcctccataactgttgtgggtactgatggccaggcttccaaacctcttaaaactccccaactctggtgccaacttacacaatactcttttaagcactcctttttagtatccccacctgcccagttcccttattaggctgagacacttttaactaaattatctgcttccctgactattcctggactacagctatatctcattgctacccttcccaatccaaagcctcctttgcatcctcctcttgtatccccccaccttaacacacaagtataagataactctaccccgtccttggcgaccgatcatgcactccttaccatctcattaaaacctaatcacccttaccccgctcaatgccaatatcccatcccacagcatgctttgaaaggattaaagcctgttatcactcgcttgctacagcatggccttttaaagcctataaactctccttacaattcccccattttacctgtcctaaaaccagacaaggtttacaagttagttcaggatctgcgccttatcaaccaaactgttttgcctatccaccctgtggtgcccaacccgtacactctattgtcctcaataccttcctccacaacccactattccgttcttaatcttaaagatgcttttttcactattcccctgcacccctcgtcccagcctctctttgctttcacctggactgaccctgacatccatcagtcccagcagattacctaggctgtactgccgcaaggcttcacagacagcccccattacttcagtcaagcccaaatttcatcctcatctgttacctatctcggcataattctcataaaagcacacatgctctccctgctgatcgtgtccgattaatctcccaaacctcaatcccttacaaaacaacaactcctttccttcctagacatagttactgcagtcagaattcctacacaagagccaggaccgcaccctgtagcctgtccaaacaacttggacttactgttttagcctagccctcatgtctgtgtgcagcagctgccgctgctttaatacttttagaggccctaaaaatcacaaactatgctcaactcactctacatttctcataacttccaaaatctgttttcttcctcacacctgatgcatatactttctgctccccggctccttcagctgtactcactctttgttaagtctcccacaattaccattgttcctggcccggacttcaatctggcctcccacattattcctgataccacacctgaacctcatgactgcatctctctgatctcctgacgttcaccccatttccccacatttccttcttccctgttcctcaccctgatcacacttagtttattaatggcagttccaccaggcctaatcgccacacaccagcaaaggcaggctatgctatagtacaagccactagcccgcctcttagaacctctcagttcctttccatcgtagaaatctatcctcaaagatataacttctcagtgttccatctgctattctactacttctcaaggattattgaggccctctcccttccctacacatcaagctccaggatttgcccccgcccaggactggcaaattagctttactcaacatgccccaagtcaggaaactaaaatacctcttagtctaagtagacactttcactagataagtagaggcctttcccacaaaggctaagaaggccaccacagtcatttcttcccttctgtcagacataattcctcagtttggccttctcacctctatacagtctgatagcagaccagcctttattagtcaaatcagccaagcattttttcaggcttagtattcagtgaaacctttatatcccttacagtcctcagtcttcaagaaaagtagaacagactaatagtctttcaaaaacacacctcaccaagctcagctaccaacttaaaaaagactagacaatacttttatcactttcccttctcagaattcaggcctgtcctcagaatgctacaaagtacagcccatttaagctcctgtatagactctcctttttattaggccccagtctcattccagacaccagaccaacttagactgtgccccaaaaaaacttgtcatccctactatcttctgtctagtcatactcctattcaccgttctcaactactcatacatgccctgctcttgtttacactgctggtttacactgtttctccaagccatcacagctgatatctcctggtgctatccccaaactatcactcttaactcttaaagtaaataaataatctttgctggcaagactatgctgaatctccttaggcactctctaatcagatgtcctaggtcatcccaattcttagaccttttatacctgtttttctccttattccgtttttcaattcatacaaaaccatatccaggccatcaccaataattctaaatgacaaatatttcttctaacaaccccacaatatcaccccttaccacaaaatcttccttcagcttaatctctcccactataagttcccacaccgcccctaatcccgctcaaagcagccctgagaaacatcacccattatctctccataccaccccccaaaaatttttactgtcccaacactttaccactatttcgttttttcttattaatataagaagataggaatgtcaggcctctgagcccaagctaagccatcatatcccctgtgacctgcctgtacacatccagatgaccggttcctgccttaactgatgacattccaccacaaaagaagtgaaaatggcctgttcctgccttaactgatgacattatcttgtgaaattccttctcctggctcatactgactcgaaagctcccctactgagcaccttgtgaccctcactcctgcctgccagagaacaacccccctttttcctttacctacccaaatcctataaaacggccccacacctatctctcttcgctgactctttagactcagcccgcctgcacccaggtgattaaaagctttattgctcacacaaagcctgtttagtagtctcttcacatggacgcgcatgaa

SEQ ID NO: 50 - DNA, 867 bp, Homo sapiens
tggtaacctgtaaccttagccccatccctgtgcccacagaaacatgtgctgtattgactcaaggtttaggggatttagggctgtgcaggatgtgctttgttaacaatgtgtttgcaggcagtatgcttggtaaaagtcatcgccatcctccattctccattaaccagggacacagtgcactgcggaaagccgcagggacctctgcccaagaaagcctgggtattgtccaggtttccccccagtgagacggcctgagatatggcctcgtgggaagggaaagacctgatcgtcccccagcccgacacccataaagggtctgtgctgaggaggattagtgaaagagggaggcctctttgcagttgagataagaggaaggcttctgtctccgacatgcccctgggaacggaatgtctccgtgtaaaacccgatcgtacattagttctattctgagacaggagaaaaccgccctgtggctggaggcgagatatgctggcggcaatgctgctctgttactctgctacactgagatgtttgggtggagagaagcatgaatctggcctacgtgcacatccgggcacagcaccttcccttcaagctatttgtgacacagatgcctttgctcacattttcttgctgacctctgctctgctgccgcattcctcatgcaaagatagtgaaaatggtaatgaataaatactgagggaactcagagaccggggccggtgcgggtcctccgtatactgagcgccgtctcctgggcccactgccttctctatactttgtctctgtgtcttatttcttttctcagtctctcatcccacctgacgagaaacacccacaggtgtggaggggctggccaccccttca

SEQ ID NO: 51 - DNA, 714 bp, Homo sapiens
ttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaacttgccttggtctctccctgtgccttaaaaccacttaaaaccacctctgcccctcagctgagttctgtctttgagaaggcaagcatcaagtttgctgcagacccattggattcaccactg

SEQ ID NO: 52 - DNA, 447 bp, Homo sapiens
gtcaggcctctgagcccaagccaagccattgcatcccctgtgacttgcacgtatacgcccagatggcctaaagcaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaccaccccaactgagcaccttgtgacccccactcctgcccgccagagaacaaaccccctttgactgtaattttcctttacctacccaaatcctataaaatggccccacccttatctcccttcactgactctcttttcggactcagcccacctgcacccaggtgaaatagccatgttgctcacacaaagcctatttggtggtctcttcacacggacgagcatgaaa

SEQ ID NO: 53 - DNA, 71 bp, Homo sapiens
aaggctgactaattctcaatatgcattttatcactcagtccactcctgacattagaaaaagctccaaaaat

SEQ ID NO: 54 - DNA, 32 bp, Homo sapiens
aagctctgctctagtcacagcccggaagctga

SEQ ID NO: 55 - DNA, 6101 bp, Homo sapiens
gtcaggcctctgagcccaagctaagccatcatatcccctgtgacctgcatgtatacatccagatggcctgaagcaactgaagatccacaaaagaactgaaaacagccttaactgatgacattccaccattgtgatttgttcctgccccaccctaagtgataggctatgttctcccccgcccttaagaaggtactttgtaatattctcccccgcccttaagaatgtactttgtacacctatcccaaacgtataaaaactaatgataatcccaccaacctttgctgactcctttctcggactcagcccacctgcacccaggtgaaataaacagccctgttgctcacacaaagcctgttggtggtctcttcacaaggatgcgtgtgacatttggtgccaaaacccaggacaggaggactccttcaggagaccagtcccctgtcttcgccctcactccgtgacctcaggtcctcagaccaaccagcccaaggaacatctcaccaacttcaaattgggtaagcagtcttttcactcttctcatgcctctcttgctacccttcaatcttcctctcttgctacccttcaatctccctgtccttccaattccaattctttttcctctctagtagagacaaggagacggccaggtgcggtggctcacgcctgcaatcccagctctcagggaggctaagaggcgggaggatagcttgagcccaggagttcgagacctgcctgggcaatatagcgagaccccgttctccagaaaaaggaaaaaaaaaaaaaaagagacaaggagacacattttatccgtggacccaaaactctggcgccagtcacggactcgggaagatagtcttcccttggtgtttaatcactgcggagatgcctgcctgattattcacccaccctccactggtgtctgatcactgcggggacacctgccttagtcattcacccacattcccttggtggcaagtcaattgcagggatgcctgctttggctgctcacccacattgcagcccagggctgctcacccacccacttctccatgtctctacctttctctttaaacttacctccttcactatgggcaaccttccactcgccattctcccttcttctcctttagcctgtgttctcaaaaacttaaaacctcttcaactcacacctgacctaaaacctaagcgtcttattttcttctacaacaccgcttggccccaatacaaacttgacaatgattccaaatagccagaaaatgacactttcgatttctccatcctacaagatctagataattcttgtcataaaatgggcaaatggtctgaggtgcctgacgtccaggcattcttttacacatcggtcccttcctaatctctgttcccaatgagattcatcccaaagctttcttctttctctcctgtctgttccttcagtctccaccccaagctctgaatcctgggaatcctccttttctacagacccatctgacctctaccctcctccccaggctgctccttgccaggccgagccagctcccaactcttcttcaacctctgctcccccaccctataacccttctattacctcccctcctcacacccggtctggcttacagtttcattccgtgaccagccctcccccacctgcccaacaatttcctctcagagaggtggctggagctgaaggcatagccaaggttaatcctcctttttctttatccaacctctcccaaatcagttagcgtttaggctctttttcatcaaatatgaaaacccagcccagtccatggcccgtttggcaacaacccttagatgctttaccgccctagacccagaggggccagaaggctgtcttattctcaatacacattttattacccaacccactcctgacattagaaaaatctccaaaaattagattctggccttcaaccccccaacagtacttaattgacctcaccttcaaggggtacagtaatacagaagagttgtaattacttgcctccgctgtgagagaaaccccagctacatctccagcacacaagaacttcaaaacgcctaaacctcaggggtcaggcattcctccaggaccgcctccccaggatcttgcttctagtgctggaaatctggccactgggccaaggaatgcctgcagcctgggattcctcctaagccgtgtcccatctgtgcaggaccccactggaaatcagactgtccaactcacccagcagccactcccagagcccctggaactctggcccaaggctctctgactgactccttcccagatcgtctcagcttagcggctgaagactgacactgcccgatcgcctcggaagcctacaggaccatcacagatgctctggataactcttacagtggagggtaagtccatcctcttctttatcaatacggaagctacacactccacattaccttctttccaagggcgtgtttcccttgcctccataactgttgtgggtattgacagccaggcgtctaaacctcctaaaactccccaactctggtgccaacttggaaaacattcttttatgcactcctttttagttatcctcacctgcccagctcccttattaggttgagacattttaactaaattttctgcttccctgactattcctgggctacagccacacctcattgcctccttttcccccagttcaaagcctccttcacatcctctccttgtatctccccaccttaatccacaagtataggacacctctactccctccttggcaacggatgatgcaccccttaccatcccattaaaacctaatcacccttaccctgctcaatgccaatatcccatcccacagcacgctttaaaaggattaaagcctgttatcactcacctgctacagcatggccttttaaagcctataaactctccttacaattccccattttacctgtccaaaaactacacgagtcttacaggttagttcaggatctgcaccctatcgaccaaattgtcttgcctatccaccctgtggtgccaaagccatatattctcccatcctcaatacctccctccacaacccattattctgttctagataaacctagctgaccccataaatcctaaatcctttccccactcccctttccattccttaaaaaacagccctaaaagatgctcccacactacctctccctaactcatcccaacctttttcattacacacagctgaagtgcagggctgtgtggtcggaattcttacacaagagccgggaccgcgccctggagcctttctgtccaaacaacttgaccttactcttttagcctagcccttacgtctgcgtgtggtggctgccgctgctttaatacttttagaggccctcaaaatcacaagctatgctccacttactctctacagttcccataactttcaaaatctattttcctcctcacacttgacgcatatactttctgccccccagctctttcagctatactcactctttgttgagtctcccacagttactattgttcctggcccagacttcaatccggcctcccacattattccggataccacacctgatccccatgactgtatctctctgatccacctgacattcactccatttccccatatttccttctttcctgttcctcaccctgataacacttggtttattgatggcagttccaccaggcctaatcgccactcaccagcaaagggaggctatgctatagtatctttcacatctatcattgaggctaccactctgaccccctccactacctctcagcaagctaaactcattgccttaacttgggccctcattcttgcaaaaggactacgagtcaatatttatactgactctaaatatgccttccatatcctgcaccaccatgctgttatatgggcagaaagaggtttcctcactactcaagggtcctccatcattaatgcctctttaataaatactcttctcaaggctgttttacttccaaaggaagctggagtcattcactgcaagggccatcaaaaggcatcagatcccactgctcagggcaacgcttatgctgataaggtagttaaagaagcagctagctttccaacttctgtccctcacggccaggactggacagtactttgcccttctcagaattagagcctgtcctcgagatgctacagggtactgtccatttgaacttttatatggacgcactttcttgctcagccctgacctcgtcccagacaccagccctctaggcaactatcttccagtcctccagcaggctagacaggaaattcgctaggctgctcatcttctcttgcctactccagattcccagccatatgaagacaccctagctggatgatcagttcttgttaagaatctgacccctcaaactctacaacctccatggactggaccccacttagtcatctatagtaccccaatggctgttcgtctgcaggatgccccaccattaggttcatcattccagaataaagctgtgcccgtcaaacagccagcctgatctctcctcttcctcctggaagtcacaagtgttcacccctactttccttaaacttatttgcatttctgaagagcagtaataacccttatgagcctaatacaacccttcattctattaggtctattcatccttaccctactttttgcaatagggctttacgcagtcacccccactacttgttctgtgccccaaaaacttgtcatccctatcttctgtctagtcatactcctattcaccattctcaactacttgtaaatgccctgcccttgtttacactgctggtttacgcttttcctccaaaccattgtagcggatatctcctggtactatccccaatccgccactcttgactccctcttagagtggatagatgaactttgctgacagggcaccctccgatacttttaccctgatgaagtcctattctttacttttatactcactcttattctcattcccattcttatgccatcctctacctctccccagctatctccaccacactatcaatctcactcactctctcctagctgtttctaaaccttctttaacaaacaattgctggctttgcatttctctttcctctaaaatcacagaggcctcgacttactcactgctaaaaaaaaaaaaaaagggggactctgggccaggcgcagtggctcatgcctgcaatcccagcactttggaacactgaggtgggcagatcacgaggtcaggagatcgagaccatcctggctaacacagtgaaattctgtctctactaagaatacaaaaacttagctgggcgtggtggcgggtgcctgtagtcccagcttcttgggaggctgaggcaggagaatggtgtgaacccggaaggcggagcttgcagtgagccgagatcacgccactgcactccagcctgggcaacaaagcaagagtctgtctcaaaaaacaaaaacaaaaacaacaaaaaacattttttaaatgaagagtgttgtttttacctaaatcaatctggcctggtatatgacaacataaaaaaactcaaggatagagccccaaaactcgccaaccaatcaaataattacgctgaacccccttggacactctctaattggatatcctgggtcctcccaattcttagtcctttaatacctgtttttctccttctcttattaggaccttgtgtcttccgtttagtttcccaattcttacaaaaccgcatccaggccatcaccaatcattctatatgacaaatgctccttctaacaaccccacaatatcaccccctaccccaaaatctttcttcagtttaatctctcccactgtaggttcccatgccacccctaatcctgctcgaagcagcccagagaaacattgctcattatctctccacatcgcccctaaaaaattttcgccaccccaacacttcaccaccattttgttttgtttttcttattaatataagaagacaggaatgtcaggtctctaagcccaagctaaatcatcatatcctgtgacctgcatgtatacatccagatggcctgaagcaactgaagatccacaaaagaactgaaaatagccttaactgatgacattctaccat

SEQ ID NO: 56 - DNA, 3642 bp, Homo sapiens
gtcaggcctctgagcccaagccaagccatcgcatcccctgtgacttgcacgtataagcccagatggcctgaagtaactgaagaatcacaaaagaagtgaatatgccctgccccaccttaactgatgacattccactacaaaagaagtgaaaatggccggtccttgccttaagtgatgacattaccttgtgaaagtccttttcctggctcatcctggctcaaaaacctcccccactgagcacctttcgaccccgactcctgcccgccagagaacaaaccccctttgactgtaattttcctttacctacccaaatcctataaaacagccccacccttatctcccttcactgactctcttttccgactcagcctacctgcacccaggtgaaataaacagccatgttgctcacgcaaagcctgtttggtggtctcttcacacggacgcgcatgaaatttggtgccgtgacttggatcgggggacctcccttcggagatcaatcccctgtcctcctgttctttgctccatgagaaagatccacctacgacctcaggtcctcagactgaccagcccaagaaacatctcaccaatttcaaatccggtaagcggcctctttttactctcttctccaacctccctcactatccctcaacctctttctcctttcaatcttggcgccacacttcaatctctgccttctgttaatttcaattcctttcattttctggtagagacaaaggagacactttttatccgtggacccaaaactccggcgccagtcacggactaggaaggcagccttcccttggtgtttaatcattgcagggacacctctctgattattcacccatgtttcaaaggtgtcagaccactcagggacacctgccttggtccttcacccttagcggcaagtcctgcttttctggggaaggggcaagtaccccaactctttctctccttgtctctaccccttctctgcttttctgggggaggggcaagtacccctcaaccccttctccttcacccttagcagcaagtcccgcttttccagaggaggggcaagtaccccaacctcgtatctctgtgccccaatcccttatttccacgccacaacctcttatatctctgcaccccagtcccttatttccacaccctgacttcttatctctgcaccccaatcccttatttccatgccccgaccccttatttctgtgccccgaccccttatttccatgccccgaccccttatttctgcaccccatcccttatttctgtgccgcaacctcttatctctgtgccccaaccccttttcccacttttctagaaggtaagaacccccgaaccccttccctccatttctctactctctcttttctctaggcttgcttccttcactataggcaactttccaccctccattcctccttctactcccttaacctgtgttctcaaaaacttaaaacctcttcaactcacacctgacctaaaacctaaatgtcttattttcttctgcaatgctgcttgaccccaatacaaactcgacagtagttccaaatagccagaaaacggcactttcaatttttccattctacaagatctaaatacttcttatcgtaaaataggcaaatggtctgaggtgactgacgtccaggcattttttacacatcagtcccttcctagtctctgtgcccagtgcaactcgtcccaaatcttctttcccttccgcctgtcccctcagtcccaaccccatgcatcactgagtctttctaatcttctttttctacagacccatctgacctctaccctcctcgccaggccaagctaggtcccaattcttccaccctataatctttttattgcctcccctcctcatacctggtccggcttacagtttccttccgtgactagccctcccccacctgcccagcaatttcctcttaaaaaggtggctggagccaaaggcatagtcaaggttaatgctcctttctctttatcccaaatcagatagcgtttaggctctttttcatcaaatataaaaacccagcccagttcatgtctcattcggcagcaaccctgcgacgctttacagccctagaccctaaaaggtcaaaaggccatcttattctcaatatacattttattacccaatctgctcctgacattaaataaaactccaaaaattagaatctggccctcaaacctcacaacaggatttaattaacctcaccttcaaggtgtacaataatagaaaaaagttgcaattccttgcctccactgtgagacaaaccccagccacatctccagcacacaagaaattccaaacacctgaaccacagcggccaggcattcctccagaacctcctcccccaggagcttgctacaagtgccagaaatctgaccaccaggccaaggaatgcctgcagcccaggattcctcctaagccgtgtcccatttgtgcaggaccccactggaaatcggactgttcaactcacctggcagccactcccggagcccctggaactctggcccaagactctctgactgactccttctcggcttagcggctgaagactgacgctgcccggtcgcctcggaagccccgtagaccatcagggacgccgagctttgggtaactctcacagtggaaggtaagcccgtccccttcttaatcaatacagaggctacccactccacattaccttcttttcaagggtctgtttcccttgcctccataactgttctaggtattgacggccaggcttctaaacctcttaaaactccccaaatctagtgccaacttagacaatactcttttaagcactcctttttagttatccccacctgcccagttcccttattaggctgagacactttaactaaattatctgcttccctgactgttcctggactacagctgtatctcattgccgcctttcttcccaatccaaagcttcctttgcgtcctcctcttgtatccccccaccttaacccacaagtataagatacctctactccctccttggtgaccgatcatgcaccccttaccgtgtcattaaaacctaatcacccttaccccactaaatgccaatatcccatcccgcagcacgctttaaaaagattaaagcctgttatcactggcctgctacagcatggccttttaaagcctataaactctccttataattcccccattttacccatcctaaaactgcacaagtcttacagattagttcaggatctgcatcttatcaaccaaactgttttgcctatccaccctgtggtgcccaagctgtacactcttttgtcctcaataccttcctccacaactcactattccgtgcttgatcttaaagatgcttttttcactattcccctgcacccctcgtcccagcctctcttcgctttcacttagactgaccctgacacccattaggctctgcaaattacctaggctgtactgccgcaaggcttcatagacagcccccattacttcagtcaagcccaaatttcatcctcatctgttacctatctcgccataattctcataaaaacacacgtgctctccctgctgatcatgtccgattaatctcccaaacctcaatcccttacaaaacaacaactcctttccttcctaggcatagttag

SEQ ID NO: 57 - DNA, 6239 bp, Homo sapiens
gtcaggcctctgagcccaagctaagccatcatatcccctgtgacctgctcctaaacatccagatggcctgttccttgccttaactgatgacattccaccacaaaagaagtgaaaatggccgttccttgccttaagtgatgacattatcttgtgaaattccttctcctggctcatcctgcctcaaaagctcccctactgagcaccttgtgacccctgctcctccccccagagaacaacccccctttgactgtaattttcctttacctacccaaatcttataaaacagccctatccttatcttccttcactgattcatttcggactcagcctgcctgtacccaggtgattaaaaagctttattgctcacacaaagcctgtttggtggtctcttcacagggatgccagtgaaatttggtgccgtgactcggatcggggaacctcccttaggagatcaatcccctgtcctcctgctctttgtttcgtgaggaagatccacctacgacctctggtcctcagaccaaccagcccaaggaacatctcaccaattttaaatccggtaagcgacctctttttactctcttcttcaaactctctcactatccctcaacctctttcttctttcagttttggtgccacacttcaatctctcccttctcttaatttcagttcctttcctttcctggtagagacgaaggagacgcattttatccgtagacacaaaactccggtgctggtcacagactcgggaagacagtcttcccttggtgtttaatcacgcggggatgcctgcctgattattcatccacgtttcagaggtgtctgaccacgcagggacacctgccttggtccttcacccttagtggtaagtaccacttttctagggggcaataagcccccaatcccttctcttcgtgtctctaccccttctctgcttttctggggggcaagaaccccccaacctcttctccttcacccttagcagcaagtaccgcttttctggggggcaagaatcccccccagccccttgtctccatttctctaccccttctccacttttctggagggcaagaaccccccaaccccttctctccgtgtctctactctctctttttactgggcttgcctccttcactatgggcaaccttccaccctccattcctccctcttcccccttagcctctgttgtcaagaacttaaaaccacttcaactcacacctgacctaaacctaaatgccttattttcttctgcaatgctgcttgaccccagtacaaactcaacagcagttccaaatagccagaaaatggcactttcgatttttccatcctacaagatctaaataattcttgtcgtaaaataggcaaacagtctgaggtgcctgatgtccaggcattcttttacacattggtccctccctagcctctgttcccaatgcgactcgtcccaaatcctccttctttccctcttgcctgtcccctcagtcccaaccccaagtgtcgctgagtttttctaatcttccttttctgcagacccatctgacctctcccctcctccccaggctgctccttgccaggctgagctaggtcccaattcttcctcagcctccccacctccaccctataatcttttaatcacttcccctcctcacaccgggtccggcttacagtttcgttctgtgactagccctcccccacctacccaggaatttcctcttaaaaagatggctggagctaaaggcatagtcaaagttaatgctcctttttctttatctgacctctcccaaatcagttagcgtttaggctctttttcttcaaatatgaaaaacccagcccagttcatggctcatttggcagccaccctgagatgctttacagccctagaccctaaaaggtcaaaaggccgtcttattctcaatgtacattttattacccaattcgctcccgactttaaataaagctccaaaaattaaattctgaccctcaaaccccacaacaggacttaattaacatcgccttcaaggtgtacagtaacagaaaaaagttgcaattccttgtctccactgtgagacaaaccccagccacatctccagcacacaagaacttccaaacgcctgaaccatagcggccaggcattcctccagaacctcctcccccaggagcttgctacaagtgctggaaatctggccactgggccaaggaatgcccgcagcctgggattcctcctaagctgcgtcccgtctgtgcggaaccccaatgaaaatcggactcttcaactcacctggcagccactcccagagcccctggaactctggcccaaggctctctgactccttcccagatcttcttggcttagcggctgaagactgacgctgccagttcgcctcagaagccccctaaaccatcacggacgccaagcttcgggtatctctcacagcagaaggtaagtccgtccccttaatcaatacggaggctacccactccacattaccttcttttcaagggtctgtttcccttgcctccataactattgtgggtatggatggccaggcttctaaacctcttaaaactccccaattctggtgccaacttagacaaaactcttttaagcactcctttttagttatctccacctgcccagttcccttgttaggccaagacactttaactaaattgtttgcttccctgactattcctgggctacagccacacctcattgctgccttttcccccagttcaaagcctccttcatattctcccccttgtatctccccaccttaacccacaagtataagacacctctactccctcgttagtgaccgatcatgcaccccttaccatcccactgaaacctaatcactcttaccccgctcaatgccaatatcccatcccacagcataatttaaaaggattaaaatctgttatcactcgcctgctatagcatggccgtttaaaacctataaactccccttacaattcccccatctcagatgtcctaaaaccagacaaggcttacaggttagttcaggctctgcgccttatcatccaaattgttttgcctatccaccccatggtgccaaacccatatactctcctagcctcaatacctccctccacaacccagtattctattctggatctcaaacatgctttctttactattcctttgcactcttcatctgagcctctctttgctttcacttggactgaccctgacacccatcaggctcagcaaattacctgggctgtactgccgcaaggctttacagacagctcccattacttcagtcaagcccaaatttcatcctcatctgttacctatctcggcataattctcataaaaacacacgtgctctccctgctgattgtgtcccgctaatctcccaaacctcaatcccttctacaaaacagcaactcctttccttcctaggcatggttaatgcagtcagaattcttacacaagagccaggaccacgccctgtagcctttctgtccaaacaacttgaccttactattttagcctagccctcatgtctgcatgcagcggctgccactgctttaatacttttagaagccccaaaaatcacaaactatgctcaacttactctctacagttctcctaacttccaaaatctattttcttcctcacacctgacacttatactttctgctcctggctccttcagctgtactcactctttgttgagtctcccacgattaccattgttcctggtccagacttcaatctggcctcccacagtattctggataccacacctgacccccatgactgtatctctctgatccacctgacatttaccccatttccccttctttcctgttcctcaccctgaacacacttggtttattgatagtagttccaccaggcctaatcaccacacaccagcaaaggcaggctatgctatagtacaagccaccagcccgtctcttagaacttctcatttcctttccatcctagaaatctatcctcaaggaaataacttctcagtgttccatgtgctattctactactcctcagggattattcaggccccctcccttccctgcaaagctggtggatttgccctcacccaggactggcaactcttaactccctcttagagtggatagatgatctttgctggcaggggaccttccaatactttcaccctgatgaagttctattctttacatttatagtcactcttattctcattcccattcttatgccaccctctacctctcccccgccatctccaccacaccatcaaccttactcattctctcctagccatttctaatccttccttagtgaacaaccactagctttgcatttccctttcttccagagcttacacagctgtccccgccttacatgcagactagacaacatctcctgtctccctacacctctgaacttcctttaatagccctcacctttaccctcctgaagaactcatttactttctagacaggtccagcaagacctccccagacatttcacatcagcaagcagccgccctcctccgcacttaattaaaaaacctttctccttatatccactctactccccccatatttagacctctcacaacacaaactattattcctgtggctgctcctttatgtatctttcatcaaagacccactgcaatccccctaggtaacctttcaccttctcgatgttcctttactcttcatctccatagctctcttcttgtttacttgtacccagccctgaaaataacagtgaaaggttgcacctatgttttctcatacaccatgaaaatcgatccttcccttctaagcagtaacctcatcggtccccattacaccctctgatggctgccgccctagctggatccctaggaactctaggtacaagacacccctttcagcactccttctcatctttttactttgcatctccaggtttgcctcgcacaaggtctcttcttcctctgtggatcctctacctacatgtgtctacctgctaattaggcaggtacatgcacactagttttacttactcccaaaattcaatttgcaaataggactgaagagctccctcttcccctcatgacaccgatacgccaaaaaagagttattccactaattcccttgcttgtcagtttaagactttctgcctccactattgctctcggtactggaatagcaggcatttcaacctctgtcaggaccttccatagcctctctaatgatttctctgctagcatcacagacatatcacaaactttatcagtcctccaggcccaaggtgactctttagctgcagttgtcctccaaaaccgccaaggccttgacttactgctgaaaatggaggactctgtatattcttaaatgaagagtgttgtttttacctaaatcaatctggcctggtgtataacaacataaaaaactcaaggatagagtctaaaaacttgccaaccaagcaagtaattacactgacgccccttggacactctctaattagatgtcttagatcctcccaattcttagtcctttaatacctgtttttctcctcttattccatttagtttattgattcatacaaaaccatatccaggccatcaccaataattctacacgacaagtgttccttctaacaaccccgcaatatcaccccttaccacaaaatcttccttcagcttaatctctcccactctaggttcccacgccacccctaatcccactagaagcaaccctgagaaacatcgcccattatctctccataccacccccaaaattttcaccgccccaacacttcaacactattttgttttatttttcttattaatataagaccggaatgtcaggcctctgagcccaagctaagccatcatatcccctgtgacctgctcctactcatccagatggactgttccttgccttaacttatgacattccaccacaaaagaagtgaaaatggccggtccttgccttaagtgatgacgttatcttgtgaaattccttctcctggctcatcctggctcaaaagctcccctactgagcaccttgtcagccccactcctgcctgccagagaacaacccccctttgactgtaattttcctttacctacccaaatcttataaaagcgccctacccttatctcccttcactgactctctttttggactcagcctgcctgcacccaggtgattaaaaagctttattgcgcacacaaaccctgtttggtggtctcttcacagggacgcaagtgaaa

SEQ ID NO: 58 - DNA, 32 bp, Homo sapiens; identical to SEQ ID NO: 54

SEQ ID NO: 59 - DNA, 5645 bp, Homo sapiens
gtccagcctctgagcccaagctaaaccatcatatcccctgtgacctgcacatacacatccagatgggcgattcctgccttaactgatgacattccaccacaaaagaagtgaaaatggcctgttcctgccttaactgatgacattaccttgtgaaattccttctcttggctcatcctggcttaaagctcccccgctgagcaccttgtgaccccccccccaacccctgcccgccacagaacaaaccccctttgactgtaattttcctttatctacccaaatcttataaaatggccccacccctatctcccttcgctggctctcttttcggactcagcccacctgcccccaggtgaaataaacagccttgttgctcgcacaaagcctgtttcgtggtctcttcacatggatgcgagtgaaattttggtgccgtgactcggatcgggggacctcccttgggagatcaatcccccgtcctgctctttgctccgtgagaaagatccacctacgacctctggtcctcagaccgaccaggccagggaacatctcaccaattttaaatcaggtaagcgacctctttttactctcttctccaacctctcactatccatcaacctctttctcctttcaatcttggcaccatctttcaatctctcccttctcttaatttcagttccttcccttttctggtagagacaactcaggagatgcattttatccatgaacccaaaactccggcgccagtcacagactcgggaaggcagccttcccttggtgtttaatcacgtggggatacctgcctgattattcacacacatttcaggtgtgtctgaccacgcggggacgcctgccttggtccttcacccttagcggcaaatgccgcttttctgggggacaagaaccccctgaccccttctctccgtgtctctactctctcttttctctggacttgcctccttcactatgggcaaccttccaccctccattcctccctctactcccttagcctgtgttctcaagaacttaaaacctcttcaactcacacctgacctaaaacctaaatgccttattttcttctacaatgcaatctgaccacaatacaaactcgacagtggttccaaatagccagaaaaaggcgctttcgatttttccatcctacaagatctaaataattcttgtcataaaatgggcaaacggtctgaggtgcctgacatccaggcattcttttacacatcagtgcctccctagtctctgttcccaatgcgactagtcccaaatcctccttctttccctcccgcctgtcctctcagtcccaaccctaagggtcgctgagtatttgtaatcttccttttctacagacccatctgacttctcccctcctccccaggctgctcctcgccaggccaagccaggtcccaattcttcctcagcctctgctcccccaccctgtaacccttttatcacctcccctcctcacacccggtccagcttacagtttcgttcagcaactagccctccccgacctgtccagcaatttcctcttaaaaaaggtggctggagctaaaggcatagtcgaggttaatgctcctttttctttatccgacctctcccaaaatcagttagcatttaggctctttttcatcaaatatgaaaaacccagcccagttcatggctcattcggcagcaaccctgagatgctttatagccctagaccctaaaaggtcaaaaggccatcttattctcaatatacattttattaccaaatccgctcctgacattaaataaaactccaaaaattaaattccggccctcaaaccccacaaacaagacataattaacctcgccttcaaggtgtacaataatagagtagaggaagccaagtagcaatatatttctgagttgcaattccttgcctccactgtgaaagaaaccccagccacatctccacacacaagaacttccaaacgcctgaactgcagctgccaaggtttactccggaaatctggccactgggccaaggaatgcccacagcccgagattccccctaagccgtgtcctgtctgtgcgggaccccactgaaaatcggactcttcaactcacctggcagccgcttccagatcccctggaactctggcccaaggctctctgagtgactccttcccagatcttctcggcttagcagctgaagactgacactgcccaatcgccttggaagcctacaggacaatcacagatgctctgggtaactctcacagtggagggtaagtccatccccttcttaatcaatacggaggctacccactccacattacttcttttcaagggcctgtttcccttgcctccataactgttgtgggtattgacggccaggcttctaaacctcttaaaactccccaactctggtgcccacttagacaacattcttttatacactcttttttaagttatccccacctgcccagttcccttattaggccaagacattttaactaaattatctgtttccctgactattcctggactacagcaacacctcattgccacccttttccccatttcaaagcctccttcacatcctcctctcgtatccccccaccttaacccacaagtataggacacctctactccctccttggtgactggtcatgcaccccttaccatcccattaaaacctaatcacccttacccccctcaatgccaatatcccatcccacagcatgctttaaaaggattaaagcctgttatcacttgcctgttacagcatggccttttaaagcctataaactctccttacaattcccccattttacctgtcctaaaaccagacaaggcttacaggttagttcaggatctgcgccttatcaaccaaattgttttgcctatccaccctgtggtgccaaacccatatactctcctagcctcaatgcccccctccacaacccattattctgtctggatttcaaacatgctttctttactattcctttgcacccttcatcccagcctctcttcgctttcacttggactgaccctgacacccatcaggctcagcaaattacctgggctgtgctgccgcaaggcttcacagacggcccccattacttcaatcaagcccaaatttctttcaatcaagcccaaatttcttcctcatctgttacttatctcggcgtaattctcataaaaacacacatgctctccctgccgattgtgtccaactgatctctcaaaccccaacaccttctacaaaacaataactcctttccttcctaggcatggttagatactttcgactttagacacctggttttgccatcctaacaaaaccattatataaactcacaaaaagaaacctatctgaccccatagatcctaaatcctttccccactcctctttccgttccttgaagacagctttagagacttcccccaccctaactctccctgactcatcagaacccttttcattacccacagctgaagtgcaggactgtgcagtcagaattcttacacaagaactgggaccacaccctgtagcctttttatcccaacaacttgaccttactgttttgcctagccctcaagtctgcgtgcggcagctgccgctgccctaatacttttagaggcccttaaaatcacgaactatgatcaacagttctcataacttccaaaatctattttcttcctcacacctgacacatatactgtctgctccctggcttcttcagctgtactcactctttgttgagtctcccacaatcaccactgttcctggcccggacttcaatccagcctcccacattattccagataccacacctgacccccacgactgtatctctctgatccacctgacattcaccccatttccccatatttccttctttcttgttcctcaccctgatcacacttagtttattgatggcagttcccaccaggcctaatcgccacacaccagcaaaggcaggctatgctatagtacaagccactaccccgcctcttagaacctctcatttcatttccatcgtggaaatctatcctcaaggaaataacttctcagtgttccatctgctattctactactcctcagggattattctggccccctcccttccctacacatgaagctcggagatttgcccccacccaggactggcaaattagctttactcaacatgccccaagtcaggaaactaaaatacctcttggcctgggtagacattttcactggataggtagaggactttcccacagggtctaagaaggccaccatggtcatttcttcccttctgtcagacataattcctcagtttgggcttcccacctcttcacagtctgataacagaccagcgtttattagtcaaatcagccaagcattttttcagactcttggtattcagtgaaacctttacatcccttaccatcctcaatcttcaggaaaggtagaatggactaatggtcctttagaaacacacctcaccaatctcagccaccaacttaaaaaggactgtacaatacttttaccacttgcccttctcagaattcaggcctgtcctcggaatgctacaggttatagcccatttaagctcctgtatggatgctcctttttattaggccccagtctcattccagataccagaccaacttggactgtgccccaaaaaacttgtcatccctactatcttctctctagtcatactcctattcactgttctcaactactcctgcatgccctgctcttgtttacactgccggtttacactgtttctccaagccatcacagctgatatctcctggtgctatccccaaactgccactcttaactcttaacgtaaataaataatctttgctggcaaggctatgctgaacctccttaggcactctctaattagatgtcctgggtcctcccaattcttagtcctttaatacctgtttttctccttctcttattccatttagttttcaattcatacaaaaccatatccaggccatcaccaataattctacacaacaaatgtttcttctaacaaccccacaatatcaccccttaccacaaaatcttccttcagcttaatctctcccactccaggttcccatgccgccccaatcccgctcgaagcagtcctgagaaacatcacccattatctctccataccacccccaaaaattttcgccgccccaacactttacaactatttcggttttttttttttcttattaatataagaagacaggaatgtcaggcctctgagcccaagctaagccatcatatcccctgtgacctgcacatacacatccagatggccagttcctgccttaactgatgagattccaccacaagagaagtgaaaatggcctgttcctgccttaactgatgacattaccttgtgaaattccttctcctggctcacctggctcaaaagctcccccgccaagcaccttgtgacccccacccctgaccaccagagaacaacccccctttgactgtaattttcctttacctacccaaatcttataaaatggccccacccctatctcccttcgctgactctcttttttggactcagcccacctgcacctggctgaaataaacagccttgttgctcacacaaagcctgtttggtgttctcttcacagggacgtgagtaaaa

SEQ ID NO: 60 - DNA, 3776 bp, Homo sapiens
tggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgagggccaagtcctcttccagcaggtcaggtgcccgtaacattacaacctcaaaagcagattaaagaaaataagacccaaccgccagtagcttatcaatactggccgccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatactaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtctgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtccctcaccacaagcggcagtgcagcagtagatttatgtactatacaagcagtctctctgcttccaggggaacccccacaaaaaatccctacaggggtatatggccccctgcctgaggggactgtaggactaatcttgggaagatcaagtctaaatctaaaaggagttcaaattcatactagtgtggttgattcagactataaaggcgaaattcagttggttattagctcttcaattccttggagtgccagtccaggagacaggattgctcaattattactcctgccatatattaagggtgaaaatagtgaaataaaaagaataggagggcttggaagcactgatccgacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagaggggatatataccaggaaagggactagggaaaaatgaagatggcattaaagttccagttgaggctaaaataaatcaagaaagagaaggaattagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacctgggttgccctctccagccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccac

SEQ ID NO: 61 - DNA, 5234 bp, Homo sapiens
gtcaggcctctgagcccaagctaagccatcatatcctctgtgacctgcacgtacatatccagatggccggttcctgccttaactgatgacattccaccacaaaagaagtgaaaatggcctgttcctgccttaactgatgacactgtcttgtgaaattccttcttctggctcatcctggctcaaaagctcccctactgagcaccttgtgacccccactctgccagccagagaacccccctttgactgtaattttcctttatctacccaaatcctataaaacggccccacccttatctcccttcgctgactctcttttcggactcagcccgcctacacccaggtgattaaaagctttattgctcacacaaagcctgtttagtagtctcctcacactgacgcgcatgaaatttggtgccgtgactcggatcaggggacttcccttaggagatcaatcccctgtcctcctgctctttgctccgtgagaaagatccacctatgacctcaggtcctcagaccgaccagcccaagaaacatctcaccaatttcaaatacagtaagtggcctctttttactctcttctccaacctccctcactatccctcaacctctttctcctttcaatcttggcgccactcttcaatctctcccttctcttaatttcaactcctttcattttctggtagagacaaaggagacacgttttatccgtggacccaaaactccggcgccagtcacggactagggaaggcagccttctcttggtgtttaatcatttcagggacacctctctgattattcacccaggtttcagaagtgtcagaccatgcaaggacgcctgccttggtctttcacccttagcggcaagtcccgcttttctggaggaggggcaagtagcccaaccccttctctccgtgtctctacccgcttctccgcctttctggggggcaagaaacccccaaccccttctccttcactcttagcggcaagtcccgcttttctagaggagaggcaagtacccgaaccccttctgtgtctctaccccttctccacctttctggggggcaagacacccccaaccccttctcctttacccttagcggcaagtcccgcttttctggaagtacaagtgccccaaccttgtatctcggcgccccaatccgttatatccacgctcctcccctcctccccaggctgctcctcgccaggccgagctaggtcccaattcttcctcagcctccgctcctccaccctacaatctttttatcacctcccctcctcacacccggtctggtttacagtttcattccgtgcatagccctcccccacctgcccagcaatttcctcttaaaaaggtggctgaagctaaaggcatagtcaaggttaatgctcctttttctttatcagacgtctcccaaatcagtgagcatttaggctctttcaccaaatatgaaaaacccagcccagttcatggctcgttcggcagcaaccctgagacgctttacagccctagaccctaaaaggtcaaaaggccgtcttattctcaatatacattttattacccaatccgttcctgacattaaataaaactccaaaaattaaattccggccctcaaaccccacaacaagacttaattaacctcaccttcaaggtgtacaataatagaggcagccaagtagcaacatatttctgagttgcaattccttgcctccactgtgagacaaaccccagacacatctccagcacacaagaactccaaacgcctgaaccgtagctgccaggggttcctccagaacctcctcccccaggagcttgctaaaagtgccagaaatctggccactaggccaaggaatgcccacagcccaggattcctcctaagccgtgtcccatctgtgcaggaccccactgaaaactggactgttcaactcacctggcagccacttccagagctcctggaactctagcccaaggctctctgactctttcccagatcttctcggcttagcagctgaagactgacactgccggatcgcctcagaagcctgcaggaccatcacagacgctctaggtaactctcacagtagaaggtaagtccgtccgcttcttaatacggaggctacccactccacattaccttattttcaagggcctgtttcccttgcttccataactgttgtgggtattgacggccaggcttctaaacctcttaaaactccccaactctggtgccaacttagacaatactcttttaagcactccttttagttatccccacctgcccagctcccttattaggccgagacactttaactaaattatttgcttccctgactattcctaggctacagccacacctcattgctgccttttcccccagttcaaagcctccttcacatcctccccttgtagctccccaccttaacctgcaagtataagacatctctactccctccttagcgaccgatcatgcaccccttaccatcccattaaaacctaatcacccttaccccgctcaatgccaatatcccatcccacagcatgctttgaaaggactaaagcctgttatcactcacctgttacagcatggccttttaaagcccataaactctccttaccattcccccattttacctgtcctaaaaccagacaaggcttacaggctagttcagaatctgcgccttatcagccaaattgttttgcctatccaccccatggtgccaaacctatatactctcctcaatacctccctctacaacccattattctgttctagatctcaaacatgctttctttattgcacccttcatcccagcctctcttcgctttcgcttagactgaccctgacacccattaggctcagcaaattacctgggctgtactgccgcaagacttcacagatagcccccattacttcagtcaagcccaaatttcttcctcatctgttgcctatctcagcataattctcgtaaaaacacacgtgctctccctgctgatcgtgtccgattaatctcccaaacctcaatcccttacaaaacaacaactcctttccttcctaggcatggttagtgcggtcagaattcttacacaagagccaggaccgcaccctgtagcctttctgtccaaacaacttgaccttactgttttagcctagccctcatgtctgcatgcagcggctgccgctgctttaatactgttagaggccctaaaaatcacaaactatgctcaactcactctctacatttctcataacttccaaaatctattttcttcctcacacctgacgcatatactgtctgctccctggctccttcagctgtactcactctttgttaagtcccacaattaccattgctcctggcgcagacttcaatctggcctcccacattcttctagataccacacctgacccccatgactgtatctctctgatccacctgacattcaccccatttccccatatttccttctttcctgttcctcccccgatcacgcttgatttattgatggcagttccaccaggcctaatcgccacaccagcaaaggcaggctatgctatagtacaagccactagcccgcctcttagaatctctcctcattttctttccattgtggaaatctatcatcaaggaaataacttctcagtgttccgtctgctattctactactcctcagggattattcaggcccccttccttccctacacattaagctccaggatttgccccacccaggactggcaaattagctttactcaacatgccccgagtcagataactaaaatacctcttagtctaagtagacactttcactagataagtacaggcctttcctacaaggtctgagaaggccaccgcagtcattccttcccttctgtcagacataattcctcagtttagccttcccacctctatatagtctgataacagaccagcctttattagtcaaatcagccaagcaatttttcaggctattagtattcagtgaaacctttatatcccttatggtcctccgtcttcaggaaaagtagaatggactaaaagtctttcaaaaacacacctcaccaagctcagccaccaacttaaaaaggactggacaatacttttaccactttgccttctcagaagtcagacctgtcctcagaatgctacaaggtacagcccatttgagctcctgtatggttgctcctttttattaagccccagtctcatgccagacaccagaccaacttagactgtgcccccaaaaaacttgtcatccctactatcttctgtctagtcatactcctattcaccgttctcaactactcatacatgccctgctcttgtttacactgccggtttacactgtttctccaagacatcacagctgatatctcctgatgctatccccaaactgccactcttaactcttgaagtaaataaataatctttgctgacaggactatgctgaatctccttaggcactctctaattagatgtcctaggtcctcccaattcttagacctttaatacctgtttttctccttctcttactccgtttagtttttcaattcatacaaaactgtatccaggccatcaccaataattctaaatgacaaatgtttcttctaacagtctcacaatatcaccccttaccacaaaatcttccttcagcttaatctctcccactcccactctaagttcccatgccgcccctaatcccgttcaaagcagccctgaaaaacatcgcccattatctctccataccacccccaaaaattttcactgtcccaacactttaccactattttgttttatttttcttattaatataagaagacaggaatgtcaggcctctgagcccaagctaagccatcatatcccctgtgacctgcacgtatacatccagatggctggttcctgccttaactgatgacattccaccacaaaagaagtgaaaatggcctgttcctgccttaactgacgacattgtcttgtgaaattccttctcctggctcatcctggctcaaaagctcccctactgagcaccttgtgaccccccactctgcccgccagagaacaacccccctttgactataattttcctttacctacccaaatcctataaaacggccccacccttatctcccttcgctgactctctttttggactcagcccacctgcacccaggtgattaaaagctttattgctcacacaaagcctgtttagtagtctcttcacacagatgcgcatgaaa

SEQ ID NO: 62 - DNA, 671 bp, Homo sapiens
ttagagtaggtagtcaggcagatatgggcaaggcaggaaaggcaggaatgtcaggcgacaatcaggtgatggtcaggcggttattaaactgtcactctaaaataattggttgcagtaggtgccagggaaaggcagtctcctaagagatagaaaacacctaaagctggtgatcagcagctttccaataagatctcaggaactgggcaagtgtgctcaagcatgcgtactaagaggcaaaatggcagattttaactggtatacaaccttcctctaggaacacttgactggtaagggaaaaacgcctcaaatgagaatgtgcacaacttcagtaaagacattgcacatgtggcccctcccaagtgctgacaggccactgcacgtgcagacagcccatgccaaggaaaaaatcaaaggagatacaaaacctcggaagcatgccaatgtataaaacgcaaagtcaaaagtcaaacagggcacctggatctctcaagttgcctgcttgcccctcttcctttggttcctgctctaaaactttctaataaactctcactcctgctcaaaaacttgcctcagtctctcactctgccttatgcctcttggatgaattctttcctttgaagaggcaagaatcaagttattgtagatccgtatggattcaccactgctaacat

SEQ ID NO: 63 - DNA, 977 bp, Homo sapiens
gtggggaagagaaagagagatcagtgtctctttctatacggactgtgtctatatagaaagaagtagacatgagagactccattttgttctgtactaagaaaaattcttctgccttgagatgctgttaatctgtaaccctaccccaaccctgtgctcgcagaaacatgccctgtgtcgactcaaggtttaatggatttagggctatgcaggatgtgctttgttaaacaaatgcttgaaggcagctagcttgttaaaagtcatcaccactccctaatctcaagtacccagggacacaaaacactgcggaaggaaggccgcagggacctctgcctaggaaagccaggtttctccccatgtgatagtctgaaatatggcctcatgggaagtgaaagacctgaccgtcccccagcccgacacccgtaaagggtctgtgctgaggaggattagtaaaagaggaaggcctctttgcagttgagataagaggaaggcatctgtctcctgctcatccctgggcaatggaatgtctcggtgtaaaacccgattgtatattccatctactgagataggagaaaaccgccttagggctggaggtgagacatgctggcggtaacactgctctttaatgcaccgagatgtttatgtatgtgcacatcaaagcacagcaccttttccttaaccttgtttatgacacagagacatttgttcacattttcctgctggccctctccccactattaccctattgtcctgccacatccccctctgggagatggtagagatggtagagataatgatcaataaatactgagggaactcggagactggggccagcgtgggtcctctgtatgctgagcgccagtcccctgggcccatttttctttctctatactttgtctctgtgtctctttcttttctcagtctctcatcccaccccacgagaaacacccacagttgtggaggggcaggccaccccttca

SEQ ID NO: 64 - DNA, 386 bp, Homo sapiens
gtcaggcctctgagcccaagctaagccatcatatcccctgtgacctgcacgtacacatccaggtggctggttcctgccttaactgatgacattccatcacaaaagaaatgaaaatggcctgttcctgccttaactgatggcattatcttgtgaaattccttctcctggctcatcctgtctcaaaagctcccctgctgagcaccccactcctgcctgccagagaacaaccctcctttttcctttacctacccaaatcctataaaacggccccacccctatctcccttcacttttcggactcagcccacctgcacccaggtgaaataaacagctttattgctcgcacaaagcctgtttggtggtctcttcacacggacgcgagtgaaa

SEQ ID NO: 65 - DNA, 87 bp, Homo sapiens
aaaaggacttgtatttatagccagacgacctactcagttactcaatttgtgaccaggaaataaccaaccttatgtatgttataaccc

SEQ ID NO: 66 - DNA, 74 bp, Homo sapiens
aaaacacttgaaatcagcagcttccaataaaatctcaggtagtgagtgagtgggcatgagcatgcacagtaaaa

SEQ ID NO: 67 - DNA, 486 bp, Homo sapiens
agaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctaca

SEQ ID NO: 68 - DNA, 5619 bp, Homo sapiens
gtcaggcctctgagcccaagctatgccatcatatcccctgtgacctgcacatacacatccagatggtcggttcctgccttaactgatgacattccaccacaaaagaagtgaaaatggccgttcctgccttaactgatgacattgtcttgtgaaattccttctcctggctcattctggctcaaaagctcccctactgagcaccttgtgacccccactctgcccgccagagaacaacccccctttaactgtaattttcctttacctacccaaatcctataaaatggccccacccctatgtcccttcgctgactctcttttcggactcagcccacctgcacccaggtgaaataaacagttttattgctgactcaaagcctgtttggtggtctcttcacacgaacgcgagtgaaatttggtgccgtgacttggatcgggggacctcccttgggagatcaatcccctgtcctcctgctctttgctccatgagaaagatccacctatgacctcaggtcctcagaccaaccagccaagaaacatctccccaatttcaaatccggtaagcagcctctttttactctcttctccaacctccctcactatccttcaacctctttctcctttcaatcttggagccacacttcaatctctcccttcttttaatttcaattcctttcattttctggtagagacaaaggagacacgttctatccgtggacccaaaactccggcgccggtcacagactgggaagacagacttcccttgatgtttaatcattgcagggacacctctctgattatttacccacgtttcagaggtgtcacaccattcagggatgcctgcctcggtccttcacccttagcagcaagtcctacttttctgtgggaggggcaagtaccccaaccccttctctccatgtttctaccccttctccacctttctagggggcaaggaacccccaaccccttctccttcacccttagcagcaagtcccgcttttctaggggaggggcaagtaccccaacctcttatatctctgtgccccaatcccttatttccatgccccgacctcgtatctctgtgccctgacccctttcccacttttctggagggtaagaacccgtgaaccccttccctccgtgtctctactctctcttttctctgggcttgcctccttcactatgggcaaccttccatcctccattcctcctccttctcccttagcctgtattcttaagaacttaaaacctcttcaactctcacctgacctaaaatctaagcatcttattttcttctgcaatgccgcttgaccccagtgcaaactcgacagttgctctaaatggccagaaaacggcactttcaatttctccatcctacaagacctaaataatttttgtcgaaaaatgggcaaatggtctgaggtgcctgacatccaggcattcttttacaaatcggtccctccctagtctctgtgcccagtgggactcgtcccaaatcttccttctttccctcctgcctgtcccctcagtcccaaccccaagcgtcgctgagtctttctaatcttccttttctacagacccacctgacctctcccctcctctccaggctgctccttgccaggccgagctaggttccaattcttcctcagcctgtctccaccctataatctttttatcacctcccctcctcacacctggtccggcttacagtttcgttcggtgactagccctcccccacctggccaggaatttactcttaaaaaggtggctggagctaaaggcatagtcaaggttaatagtcctttttctttatcccaaatcagacagcatttaggctctttttcatcaaatataaaaatccagcccagttcatgactcgtttggcagcaaccctgagacactttacagccctagaccctaaaagttcaaaaggccatcttagtctcaaaatacattttattacccaatctgctcccgacattaaatgaaactccaaaaattaaattctgaccctccaaccccacaacaggatttaattaaccttgccttcaaggtgtacaataatagaaaaaagttgcaattccttacctccactgtgagacaaaccccagccacatctccagcacataagaacttccaaacgcctgaatcgcagtggccaggcattcctccagaacctcctcccccaggagcttgctgcaagtgccagaaatctggccactgggctaaggaatgcctgcagcccaggattcctcctaagccatgtcccatctgtgtgggaccccactgaaaattggactgttcaactcacctggcagccacttccagagcccctgggactctggtccaaggctgtctgactgactcctgcccagatcttctcggcttagcagctgaagactgacactgcccgatcgcctcagaagcctacaggaccatcacagatgctctaggtaactcttacagtggagggtaagtccgtccccttcttaatcaatacggaggctactcactccacattaccttcttttcaagggcctgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctaggctacagccacacctcattgccacctttttctccagttcaaagcctccttcacatcctccctttgtatctccccaccttaacccacaagtataagacacctctactccctccttggtggccaatcatgcaccccttaccatttcattaaaatctaatcacccttaccctgctcagtgccaagatcccatcccactgcatgctttgaaaggattaaagcctattatcacttgcctgctagagcatggccttttaaagcctataaactctccttacaattcccccattttacctgtcctaaaaccagacaaggcttacaggttagttcaggatctgcaccttatcaaccaaattgttttgcctatccatcccatggtgccaaacccatatactctcctatccttaatacctccctctacaaaccattattctgtactggatttcaaacatactttctttactattcctttgcacccttcatcccagcctctctttgctttcacttagactgaccctgacacccattaggctcaacaaattacctgggctgtactgctgcaaggcttcacagacagcccccattacttcagtcaagcccaaatttcatcctcatctgttacctatctcagcgtaattctcataagaacacacgtgctctccctgctgatcgtgtccgattaatctcccaaacctcaatcccttacaaaacaacaactcctttccttcctaggcatggttagtgtggtcagaattcttacacaagagccaggactgcaccctgtagcctttctgtaaacaacttgaccttactgttttagcctagccatcatgtctccgtgcagcggctgctgccaccctaatacttttagaggccctcaaaatcacaaactatgctcaactcactctctacatttctcataacttccaaaatctattttcttcctcatacctgatgcatatactttctgttccccggctccttcagctgtacccactctttgttaagtcccactattaccattttcctggcccgtacttcaatctcgcctcccacattattcctgataccacacctgacctccatgactgtatctctctgatccatctgacattcaccccatttccccatatttccttctttcctgttcctcaccctgatcacgcttgatttattgatggcacttccaccaggcctaattgccacacaccagcaaagccaggctatgctatagtacaagccactagcccgcctcttagaacctctcatttcctttccatcctggaaatctatcctcaaggaaataacttctcagttgtccatctgctattctactactcctcagggattattcaggccccctcccttctctacacatcaagctcaaggatttgcccctgcccaggactggcaaattagctttactcaacatgccccaagtcacaaaaactaaaatacctcttagtctaagtagacactttcactagacaggtagaggcctttcctacagggtctgagaaggccaccgcagtcatttcttcccttctgtcagacataattcctcagtttagccttcccacctctatacagtctgataacagaccagcctttattagtgaaatcagccaagcagtttttcaggctcttagtattcagtgaaacctttatatcccttacagtcctccatcttcaggaaaggtagaacggactaaaggtcttttaaaaacacacctcaccaagctcagccaccaacttaaaaatggactggacaatattttaccactttcccttctcagaagtcagacctgtcctcagaatgctacagggtacagcccatttgagctcctgaatagatgctcctttttattaggccccagtttcatttgacaccagaccatcttagactgtgccccaaaaaacttgtcttccctactatctctgtctagtcatactcttattcaccgttctcaactactcatacatgccgtgctcttgtttacactgccagtttacactgtttctccaagccatcacagctgatatctcctggtgctatccccagactgccactcttaactcttgaagtaaataaataatctttgctgacaggactatgctgaatttccttaggcactcttatagatgtcctaggtcctcccaattcttagacctttaatacctgtttttctccttctcttactcggtttagtttttcaattcatacaaaaccgtatccaggccatcaccaataattctaaatgacaaatgtttcttctaacagtcccataatatcaccccttaccacaaaatcttccttcagcttaatctctcccactctaggttcccatgccgcccctaatcctgctagaagcagccctgagaaacattgcccattgtctctccataccacccccaaaaatttttaccgtcccaacactttaccactattttgttttatttttcttattaatataagaagacaggaatgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgaccccccactctgcccgccagagaaaacccccctttgactgtaattttcctttacccaaatcctataaaatggccccacccctatctcccttcgctgactctcttttgggactcagcccacctgcacccaggtgaaataaacagctttattgctcacacaaagcctgtttggtggtctcttcacagggatgcgagtgaaa

SEQ ID NO: 69 - DNA, 5603 bp, Homo sapiens
cctttgctgactctctttttggactcagcccacctacacccaggtgaaataaacagccttgttgctcacacaaagcctgtttggtggtctcttcacacagaagcatgagacatttggtgctgaagacccgggtcagagggactccttcgggagaccagtcccctgtcctcaccctcactccgtgaagagatccacctatgacgtcaggtcctcagaccaaccagcccaaggaatatctcaccaatttcaaatcgggtaaacagtcttttcactctcttctccagcctctctccctacccttcaatctccctgtccttccaagtccagttatttttcctctctaatagagacaaacgagacacattttatccatggacccaaaactctggcgccagtcaccaacttaggaagacagcctacccttggtgtttaatcattgcagggtgtgcctgcttgattattcacccacaccccattggtgtctgatcaccacggggatgcctgccttggtcattcacccacattcccttggtggcaagtcaattgtggggacacctgctttggctgctcacccacattgcagcccaggactgctccccaccccgcttctccgtgtctctacccttctctttaaacttgcctcctttactatgggcaaccttccaccctccatttctccttcttctcccttagcctgtgttctcaagagcttaaaacctcttcacctcttgcctgacctaaaatctaagcatcttattttcttctccaacaccgcttggccccaatacaaactcgacaatggttctaaatggccagaaaatgacactttcgatttctccatcccacgagacctagatactttttgtcgaaaaaagggcaaatggtctgaggtgccttacgtccaggcatttttcacactttgttccctccttagtctctgttcccaatgcgactcatcccaaatcctccttctttccctcccgcctgtcccttcagtctcaaccccagtcgtcactgagtcttgtgaatcttccttttctgctgacccatctgacccctcacctcctccccagactgctcctcctcagctcgctccccgccaggctgaatcaggctccaactcttcttcagcctctgctccctcaccctataacccttctattaactccccttcccacacccggtctggtttacagtttcattctgcgactagctctccccctcctgcccaacaatttcctcttagagaggtggctggagctgaaggcatagtcagagtacatgtgcctttttctctaccaaacgtttcccaaatcagccagcgtttaggctctttctcatcagacaccaataaatatatacaggaattccaatatctaactctgtcctacagtttaacctggagagacttaaatgtcagcctaacttctaccctctccccagatgaatgggaaagagtcttctctctagcccaatctcacgctgataatcaccggcttcatgagccagacctccaggaaggcattagagcagttccctgagaagatcccctatggaactatcaggcagattccccaggtatagctaggcgaaattacatggtttcttgcctagttgaagggcttaaaaaggcagctcacaaagctgttaattatgacaaacttaaagaaactacccaaggtaaagatgaaaacccagcccagttcatggcctgcttagttagcagaaatccttagatgctttaccgccctagacccagagggaccagaaggtcaccttattcttaatatgcattttatcacccagtcagctcctgacattagaaaaaagcttcaaaaattggaatccggccttcaaaccccacaacaggaattaatcaacctcgccttcaaggtgtacaataatagagaggaggtggccagacagcaacgcatttctgagttacagctacttgcctccgctgtaagacaacccacaaccacatctccagcatacaaaaaaacttcagaacatccaagccacagctcccagaggctccttaaaaacatcctcgtggaccttgtttcaaatgccaaaagcctggccactgggcctcagaatgcccacggcccgggattcctcctgagccgtgccctgtctgtgcaggcccccactggaggtcagactgtccgactcacattgctgctgctcctgaagcccctggagcccaaacccaatgttccctggccaactccttccagatctgatgctgccggatcacctcggaagcctcctggaccatcacagatgctttgggtaactctcacagtggagggtaagtacatccccttattaatcaatacggaggcaacccactccacattaccttcttttcaagggtgtgtttcccttgcctccataactgttgtggattatgacagccaggcttcttaacctcttaaaactccccaactctggtgccaacttggacaattttcttttatgcactcctttttagttatcctcacctgcccagctcccttattggctcgagacattttaactaaattacatgcttccctgactattcctaggctacagccatacctcattaccgcccttttcccccagttcaaagcctccttcacatcctctccttgtatctccccaccttaatccacctctactccctccttgaggatggatgatgcaccccttaccatcccattaaaacctaatcacccttaccccgatcaatgccagtatcccatcccaccgcatgctttaaaaggattaaagcctgttatcacttatctgttgtagcatggccttttaaagcctataaactctccttacaattcccccattttacctgtccaaaaactggacaagccttacattttagttcaggatctgcgccttatcaacaaaattgtcttgcctatccaccccatggtgccaaacccatatattctcctatcctcaatacctccctccacaacccattattctgttctagataaacctagctgaccccataaatcctaaatcctttccacactcccctgtccattccttaaaaaacagccctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaaacagccctaaaatctgctcccacactagttctccctaactcatcccaacctttttcattacacacagccgaagtgcagggctatgtggttggaattcttacacaagagccaggaccacgccctgtagcctttctgtccaaataacttgaccttactgttttagcctagccctcatgtctgcgtggggtggctgccactgccttaatacttttagagaccctcaaaatcacaaactatgctcaactcactctctacagttctcataacttccaaaatctattttcttcctcacacctgatgcatatactttctgccctcctccactacctctcagcaagccaaactcattgccttaactcgagccctcactcttgcaaaaggactacgtatcaatatttatactgactctaaatatgccttccatatcctacaccaccatgctgttttatgggctgaaagaggtttcctcactactcgagggtcctccatcattaatgcctctttaataaaaactcttcttaaggccgctttacttccaaaggaagctggagtcattcactgcaagggccattaaaaggcatcacatcccatcgctcagggcaacgtttatactgataaggtagctaaagaagcagctagccttccaacttctgtccctcacggccagtttttctccttctcattggtcactcccacctactcaccgactgaaacttctacctatcaacctcttcccacacaaggcaaatggttcttggaccaaggaaaatatctccttccagcctcacaggcccattctaatctatcatcatttcataacttcttccatgtaggttacaagctgctagcccgcctcttagaacctctcatttcctttccatcatggaaatctatccttaaggaaatcacttctcagtgttccatctgctattctactactcctcagggattgttcaggccccctctcttccctacacatcaagctcggggatttgcccctgcccaggactgggaaattgactttactcacatgccccgagtcagaaaactaaaatacctcttggtctgggtagacactttcactagatgggtagaggcctttcccacagggtctgagaaggccaccacagtcatttcttcccttttgtcagacgtaattcctcagtttggccttcccacctatatacagtccaataacgggcctgcctttattagtcaaatcacccaagcagtttctcaggctcttggtatttagtggctcctggttttacctcaaatcgccacccttaagcctctcttgaattggatagaagatcttcagtggcaaggtaccctccaatactttcaccctgatgaagtcctattctttatttttatactcactcttattctggttcccgttcttatgccaccttctacctctccgcagctatctccaccacactatcaaattcactctctcctagccgtttctaatccttctttaacaaacaattgctggctttgcatttcactttcctccaaaatcgctgaggccctgacttactcactgctaaaaaaaagggggggactgtatatttgtaaatgaagagtgttgtttttacctaaatcaatctggcctggtatatgacaacataaaaaaaactcaaggatagagcccaaaaacttgccaaccaagaaaataattatgctgaaccccctttgacactctgtaattggacgtcctgggtgctcccaattcttagtcctttaatacctgtttttctctttctcttatttggaccttgtgtctttcgtttagtttctcaattcatacaaaaccacatccaggccatcaccaataattctatactacaaatgctccttctaacaaccccacaatatcaccccttaccccaaaacctttcttcagttgggtctctcccactgtaggttcccacgccaccccaatcccgcttgaagcagccctgagaaatcacccattatctctccataccaccccaaaaaattttcaccgccccaacactttaccactatttcattttatttttcttattaatataagaagacaggaatgtcaggcctctgagcccaggctaagccatcataacccctgtggcctgcatgcatacatccagatggcctgaagcaactgaagatccacaaaagaagtgaaaatagccttaactgataacattccaccat

SEQ ID NO: 70 - DNA, 4087 bp, Homo sapiens
cccctccctcggcaacccgtttacgacccaaaacagggatccaaacgcccctgagagagcagcggtatactgggagagaggaggatggtcacgtggtggagagacgtgtttttgtgtaccagcccttcacctttgccgaccttctcaactgggaaaacaataccccgtcctagagcgaaaagccgcaagcactaattgatttgctccaaactgttatccagacccacaaccccacctgggctgatcgccaccggttgctcatgttactctttaagagagatgaaaggcaaaaggcggagagggctccacgtagcaactaagtggctagaggaacatacaccagctgattatcaaaaaccccaagagtatggaaggacccagttaccaggaacccacccccagttggacccacacgaaagagaggatatgcaaaggctaaactgagacagggaagctctcttggaaggattcaagaggggagctcagaaggccacaaacgttaacaaggtctctgaggtcattcagggaaaagaagaaagtccagcacaattctaccagagactgtgtgaggcctatggtatgtatactccccttgatcctgataaccctgaaaatcagcgcatgattcacatggctttagtccgtcaaagcgcggaagacgttagaagaaaactgcagaagcaggctgggcttgcagggatgaatacatcacattgatgagaaatagctaagcaggtgtttgtaaacagggatgcagtaagccgcgagggaaagtgcaaagagaatgaaggtcaggcccggtgaaacgctgacctgtttgttagctgcagcaatcagagctgtcccctcaaagaagcaagggaaggggggccctgggaaagaaactcagcttggctgtcagagtttgcagcgtcactagtatgcttattgtaaagaaataggatagtggaagaacaaatgccctgagctcaaaagaaaacaaggtgactcagagcaggaggccccggacaaggaggaaggggcccggctcaacctggcagaagggttatcggactgagggaaaccaggctcaagtgttctcaaagagcctctggtcagaatgacagtcgagggtagagacattgtttttcttgtagatagcggtgctgaacattcgctagtagccgccccggtcgcccccttatccagaaagactattgacgtcaccagagccacgggggtttcagcaaagcaagctttctgcttgcctgggacttgcactgtaggaggacatcaagtgattcatcagtttttgtacatgcctggctgtcccttgcccttgttgggaagggacttgcttagcaagctgagagctgctctctctttgacagaacacagctctttgctgctaaagttacccaccacgggagtcattatgacccttacggtcccccgagaggaggaatggagacttttgtgaactgagccaggccaagagagaagaccagctctggctaagcggtggccaagagtacaggcagaagacaaccctccagggttggccagttaagactggggcccagccgcttaggcaaaaacaggacccggtccccagagaagctcttcaaggtatccaggtccttcttaagcacctaagaactttgggtatgatagttccttgtcagtctcaacggaacactcccctcctgcctgttcccaagccatggaccaaggactacaggccgggacagcattcacgcttgcttagtcaagctaccctgactttccatccaacagtacctagcccgtccacattgttggggttgctgccagccgaggacagctggttcacctgcttggacctgagagacgctttctttcctatcagattagccccggagagccagaagctgtttgcctttcagtgggaagatccggagtcaggtgtcactactcagtacactttgaccgagcttccccaagagttcaagaactcccccaccatcttcagggaggcgtgggctcgagacctccagaagtttcccaccagagacctaggctgcgcgttgctccgctaggttgatgagcttttgctgggacaccccacggcagtccggtgcgccaagggaatggattgccctacgccaacacctggaggactgtgggtgtaaggcgtccaagaagaaagctcagatctgcctacagcaggtacgttccttgggatttactatccgacaggggcaacgcagcttgggatcagaaagaaagcaggtcatttgtaatctagcagagcctaagagcagaaggcaggtgagagaattcttaggagctgtgggatttgtagactgcggatcccaaactttgcagtattagccaagcctttgtatgaggtcaccaatggggcggggaccgggaactttttgaatggggatcccaacaacagcaagtctttcatgagttaaaggagaaacttatgtcagccccagccctggggctaccctatctgacaaagccttttacatcctatgtgtcagagagagagaaaagatggcagccggactttgaacccaaactgtgtggccctggctgaggccggtggcctacctctccaaacaactagatggggtctctaaaggatggcccctgtgtttgagggccttggcagcaactgccctgctagtacaagaagcaaagaagctgactcttgggcagaacctgaacataaaggccccccatgctgtggtgactttaatgaatactaaaggacatcattggctaacgaatgccagactcaccaagtaccaaagtttgctctgtgaaaatccccatataaccattgaagtttgtaacaccctacaccccgccaccttgctcccgctatcagagagccctgtcgagcatgattgtgtaaaattgttggactcagttgactctagcagacctgacatccgggaccagccttgggcatcagtagactgggaactatacgtgcatgggagcagcttcttcaacccccaaggagagagagttgcagggtatgcagtgataaccctggacactgttgttgaagccagatcgttgccccaggccacttcagcccagaaagctgaactcattgctttcattcgggccttagaactcagtgagggtgagactgtcaacacttacactgattcttggtatgcctttttaacccttcaagtgcatggagcatgctagaaagaaaagggcctattgaactctgggggaaaaggcagaaaatatcaaccagagatcttccatttattagaagcagtatggaaaccccacaaggtggcagttatgcattgcaggggacaccagcgagcttccaccttggtgggcttggggaattcccgcactgactcagaggctcgaaaagcagcatctgcccctttccaggcatcagtcacagctcctctgctccctcaagcacctgatcttagacctgcttattctaaagaagaaaaggactttctccaggtagagggacaagtgatggaagaaggatggattcggttaccagatgggagagtagctgtgccacagctgcgaggagctgcagttgtactggctgtgcaagaaaccacccatcgaggtcaggagtcactgcaaaaagttgttaggccggtatttctacatctcgcctttctcagcccttgccaaaacagtgaggcagtgatgtgccagctgccgacagcatgatacgaggcaaggtctagccattccacccggcatacaagcttatggagcggccccctttgaagatctccaggtagacttcacagagatgccaaagtgtggaggtaacaagtatttactagttcttgggtgtacctactctgggtgggtggaggcttatctaacacaaactgagaaagctcgtgaagtaacccgtgtgcttcttcgagatctgattcgtagattgggactgcccttctggatcggctcagataacgggcctgcgtttgtggctgacttgctacagaagacggcaaaagtattggggatcacacggaaactgcatgccgcctcccggcctcagagttccggaaaggtggagcggatgaatcggactatcaaaaataat

SEQ ID NO: 71 - DNA, 1386 bp, Homo sapiens
caggtgggtaactcctcccacatgagtggtctgcctaccctcaggaatattttttgtctgtggtacctcagcctatcattgtttgaatggctcttcagaatctatgtgcttcctctcattcttagtgcctcctatgaccatctacactgaacaagatttatacaatcatgtacctaagccccgcaacaaaagagtacccattcttccttttgttatcagagcaggagtgctaggtgtgctgtgtggcggtatcacaacctctactcagttctactacaaactgtctcaagaactagatttatacaatcatgtacctaagccccgcaacaaaagagtacccattcttccttttgttatcagagcaggagtgctaggtgtgctgtgtggtggtatcacaacctctactcagttctactacaaactgtctcaagaactaaatggtgacatggaatgggtcgccgactccctggtcaccttgcaagattaacttaactccctagcagcagtagtccttcaaaatcgaagagctttagacttgctaaccacggaaagagggggaacctgtttatttttaggggaagaattctgttgttatgttaatcaatctggaattgttaccgagaaatttaaagaaattcaagatcgaatgcaatgtagagcagaggagcttcaaaacactggaccctggggcctcctcagccaatggatgccctgaattctccccttcttaggacctctagcagctataatattgttactcctctttggaccctgtatcttttatttccttgttaagtttgtctcttccagaattgaagctgtaaagctgcaaatcgttcttaaattggagccccagatgcagtccatgactaaaatctaccaaggacccttggactggcctgctagcccatgctccgtgttaatgacattgaaggcacccctcccaaggaaatctcaactgcacaacccctattatgccccaattcagcaggaagcagttagagcggtcgtcgaccaacctccccaacagcacttgggttttcctgttgagaggggttactgagagacaggactagctggatttcctagactgactaagaatccctaagcctagctgggaaggtgaccacatccacctttaaacatggggcttgcaacttagctcacacccaaccaatcaggtaataaagagacctcactaaaatgctaactaggcaaaaacaggaagtaaagaaatagccaatcatctattgcctgagagcacagcaggaaggacagtgatcaggatataaacccaggcattcgagccagcaacggctaccctctttgggtcccctccctttgtatgggagctctgttttcactctattaaatcctgcaactgca

SEQ ID NO: 72 - DNA, 7330 bp, Homo sapiens
gtagggaaaagaaagagagatcagactgttactgttgtctatgtagaaaaggaagacataagaaactccattttgacctgtaccctgaacgattgttttgccccgagatgctgttaatctgtaactttgccccaaccttgagctcacagaaacatgtgttgtatggaatcaaggtttaagggatctagggctgtgcagtatgtgccttgttaacaaaatgtttacaggcagtatgcttcgtaaaagtcatcaccattctccattctcgataagccaggggcacaatgcactgcggaaagccgcagggacctctgccctggaaagccgggtattgtccaaggtttctccccatgtgatagcctgagatatggcctcgtggggcgggaaagacctgaccgtcccccagcccaacacccgtgaagggtctgtgctgaggaggaaggcctcttgcagttgagataagaggaaggcctctgtctcctgcctgcccctgggaactaaatgtctcagtataaaactcgattgtacatttgttctcttctgagataagagaaaacccgccgtgtggcgggaggcgagacatgttggtggcagcaatgctgctctgttactctttactccactgagatgtttgggtggagaaaagcataaatctggcctatgtgcacatccaggcatagtaccttcccttgaacttatttgtgacacagattcctttgctcacatgttttcttgttgaccttctccacactatcaccctgttctcctgccacattccccttactgagatagtaaaaatagtaatcaataaatactgagggaactcagagaccggtgccagtgcgggtcctccgtatgctgagcaccagtctcctgggcccactgttctttctctatactttgtctctgtgtcttatttcttttctcagtctctcgtcccacctgacgagaaatacccacaggtgtggatggggctggccctcttcatttggcgcccaacgtggggcctttctctagggtgaaggtgcgctaagaccgtgagcattgaggacagtcgatgagagattcccgagtacgtccacggtgagccttgcggtaagcttgtgcacacggaggaacccagggtaacaatgggacaaactgaaagtaaatatgcctcttatctcagctttattaaaattcttttaagaagaaggggagttagagcttctacagaaaatctaattatgctatttcaaacaatagaacaattctgcccatagtttccagaacagggaactttagatctaaaagactgggaaaaaattggcaaagaattaaaacaagcaagtagggaaggcaaaatcatcccgcttacagtatgcaatgattgggccattattaaagcagctttagaaccgtttcaaacagaagaagatagcgttttggtttctgatgcccctgaaagctgtgtaatagattgtgaagaagaggcggggacagagttcaagaaaggaacggaaagttcacattgtgaaaatgtagcagagtctgtaatggctcggtcaacacaaagtgttgactacaatcaattacaggaggtaatatatcctgaatcaccaaaactgggggaaggaggtccagaaccatcggggccgtcagggctaaaaccacgatggccacctcctcctcagtcgagtgagtgctgggggagggagcctgaaaccaggctggctgcaactcggctcgcggtgcccattattgcccaaccggcagttcactgcggtgaaggagcaattcagactcgccctgtagcatcctgtctgggtcaaacagtggccgctccctaaggaaaagttaggggcgctacataaaatagttaaaaaaactatttaaaaaaggacatgtttcacccactgtctctccttagaattcgccagtgtttgtaattcagaaaaaatccggcagatggcgcatgctaaccgacttaagagccgctaatgccgtaattcaacccatgggggctctccaacgcaggctgccctctccggccgtgatccccaaaggttggcctttaattataattgatctgaaggattgcttttttttttttttttttttttaccattcctctggcaaaacaggattttgaaaaatttgcttttgctataccagccataaataataaagaaccagccaccaggtttcagtggaaagtgttgcctcagggaatgcttaatagtccaactatttgtcagacttttgtagctcaagctcttcaaccagttagagacatgttttcagactgttatatcattcattatgttgatgatattttgtgtgctgcagaaatgagagacaaattaattgactgttacacatttctgcagacagaggttgccaacgcaggactgacaatagcatctgataaaattcaaacaacagctccttttcattatttagaaatgcaggtagaggaaaggaaggttaatcctcaaaagatagatagaaatgagaaaagacacattaaaatatgaaatgactttcaaaaattgctgggagatattaattggattcggtcaaccctaggcatccctacttatgccatgtcaaatttgttctctatcttaagaggggatccagaatcaaatagtaaaagaacattaactccagaggcaactaaagaaattgaattagttgaagacaaaattcggtcagcacaagtaaatagaatagatcacttagccccactccaacttttgatttttgctactgcacattctccaacaggcatcattgttcaaaatacagatcttgtggagtggtccttccttcctcacagtacgattaagacttttacattgtacttggatcaaatggctacattaattggtcaggcaagactacgaatagtaaaattgtgtggaagtgacccagataaaatcattgttcctttaaacaaggaacaggttacacaagcctttatcaattctggtgcattgcagattggtcttgctgattttgtgggaattattgacaatcattacccaaaaacaaaaaccttccagtttttaaaattgactacttggattttacctaaaattaccagacatacacctttagaaaatgctctgacagtgtttactgatggttccagcaatggaaaggtggcttacaccaggccaaaaaaacgagtcactgaaactcaatatcactcagctcaaagagcagagttggttgctgtcatttcagtgttacaagattttaatcagcttattaaccttgtatcagattctgcatatgtagtacaggctacaaaggatgttgagacagccctagtcaaatacagtatggatgatcggttacaccagctgtttaatttgttacaacaaactgtaagaaaaagaaatttcccattttatattactcatgttcaagcacatactaatttaccagggcctttaactaaggcaaatgaacaagctgacttgctagtatcatctgcattcatagaagcacaagaacttcatgccttgactcatgtaaatgcaacaggactaaaaaataaatttgatatcacatggaaacaggcaaaaaatattgtacagcattgcacctagtgtcaagtcttacactggcccactcaggaggcaggagttaatcccagaggtttatgtcctaatgcattatggcaaatggatgtcacacatgtaccttcatttggaaaaatgtcatttgtccatgaagacagttgatacttattcacatttcatatgggcaacctgccagacaggagaaagtacttcccatgttaaaagacatttattatcttgttttgctgtcatgggagttccagaaaaaattaaaacagataatgggccaggatactgtagtaaagcatttcaaaaattcctaaatcagtggaaaattacacatacaacaggaatcccctataattcccaaggacaggccataattgaaagaactaataaagctcaattggttaaacaaaaaaaggaaaaagatagtaaggagtataacactcctcagatgcaactcaatctagcactctatactttaaaatttttaaacgtttatagaaatcagaccactacttctgcagaacaacattttactggtaaaaagaacagcccacatgaaggaaaactgatttggtggaaagacatcaaaaataagacatgggaaatagggaaggtgataacctgggggaaaggctttgcttgcgtttcaccaggaaaaaagtcagcttcctgtttggatacccactagacatttaaagttctacaatgaacccatcggaaatgcaaagaaaagcgcctccgcggagacagaaaacccgcaatcgagcatcatcgactcgccaggtgaacaaaatggtggtatcagaagaacagatgaagttgacatccaccaaggaagtggagccgccgacctgggcccaactaaagaagttgacacagttagctgaaaaaagcctgaagaaaacaagggtaacacaaactccagagaatatgctgcttgcagttttgatgattgtatcaatggtggtaagtgtccccatgtctgcaggagcagctgcagctaattatacttactggacctatgtgcctttcccgcccttaattcgggcagtcacatggatagataatcctattaaagtatgtgttaataatagtgcatgagtaccaggccccacagatgattgttgccctgcccaacctgaaaaagaaggaatgatgataaatatttccattgggtatcattatcctcctatttgcctagggaaggcaccaggatatttaattcctacaacccaaaattggttggtagaagtacctactgtcattgccagcaatagatttacttatcacatggtaagtgaaatgtcactcgggccacagataaataatttacaggatccttcttatcaaagatcattaaaatttaggcctaagaggaagccttgccccaaggaaattcccaaagaatcaaaaggcccagaagtctcagtttgggaagaatgtgtggctgatactgctgtggtattacaaaacaatgaatttggaactattatagactgggcccctcaaggccaattatattatgattgtacaggccagactcactgatgttcacaggccccatccatctggcccactaatccggcctatgatagtgatttaactgaaaggctggaccaggtttacagaaggttagaatcaccctatccatggaaatggggtgaaaagggaatttcatcacttcgaacaaagttagttagtcctgttgttggtcctgaacacccagaattatggaagcttactgtggcctcgcaccacattagaatttggtctggaaatgaagctataggaacaagagatcgtaagccatattatactattaacctaaattccaatctgacaattcctttgcaaagttgtgtaaaacccccttatatgttagttgtaggaaaaatagttattaaaccagattcccaaactataacctgtgaaaattgtagattgtttacttgcattgattcgacttctgattggcagcaccatattctgctggtgagggcaagagagggcgtgtggatccctgtgtccatggaccgaccgtgggaggcttccccatccgtccatattttaatggaagtattaaaaggagttctaactagatccaaaagattcatttttactttaattgcagtcattatgggtcttgttgcagtcacagctactgctgtggctgctggaattgctttacactcctctgttcaaatggtaaaatatgtaaataattggcaaaagaattcctcaaaattgtggaattctcagacccaaatagatcaaaaattggcaaaccaaattaatgaccttagacaaactgtcatttggatgcgagataggctcatgagcttgaaatatctttttcagttacagtgtgactggaatacgtcagatttttgtattacaccccgagcctacaatgagtctgagcatcactgggccatggttagatgccatctacaaggaagagaagataatcttactttagatatttcaaaattaaaagaacaaatttttgaggcatcaaaagcccatttaaatctggtgccagaaactgaggcaatcgtgaaagctgctgatggcctcacaaatcttaatgccgtcacttgggttaaaactatcagaagttccactattgtaaatttcatattaatccttgtatgtctgttctgtctgttgttagtctacaggtgtatccaacagctccgaagagacagtgaccagcgaaaacgggccgtgatgatgatggtggttttgtcagaaagaaaagggggatatgcaggcaagagaaagagagatcagactgttactgttgtctgtgtagaaaaggaagacataagaaactccattttgacctgtaccctgaacgattgttttgccccgagatgctgttaatctgtaactttgccccaaccttgagctcacagaaacatgtgttgtacagaatcaaggtttaagggacctagggctgtgcaggacgtgccttgttaacaaaatgcttacaggcagtatgcttggtaaaagtcatcgccattctccattctcgataaaccaggggcacaatgcactgcggaaagccgcagggacctctgccctggaaagcgggatattgtccaaggtttctccccatgtgatagcctgagatatggcctcgtgggatgagaaagacctgaccgtcccccagcctgacacccgtgaagggtctgtgctgaggaggattagtaaaagaggaaagcctcttgcagttgagataagaggaaggcctctgtctcctgcctgcccctgggaactaaatgtctcggtataaaactctattgtacatttgttctcttctgagataggagaaaacccaccctgtggcgggaggcgagacatgttggtggcagcaatgctgttctgttactctttactccactgagatgtttgggtggagaaaagcataaatctggcctatgtgcacatccaggcatagtaccttcccttgaacttatttgtgacacagattcctttgctcacatgttttcttgctgaccgtctccgcactatcaccctgttctcctactacattccccttactgagatagtaaaataataatcaataaatactgagggaactcacagaccggtgctggtgcaggtcctccggatgctgagtgccgtctcctgggcccactgttctttctccatactttgtgtcttatttcttttctcagtctctcgtcccacctgacgagaaatacccacaggtgtggaggggc

SEQ ID NO: 73 - DNA, 6255 bp, Homo sapiens
gtcaggcctctgagcccaagctaagccatcatatgcctgtgtatatgcctatgacctgcatgtacacatccagatggccggttcctgcgttaactgatgacattccaccacaaaagaagtgaaaatggcctgttcctgccttaactgatgacattatcttctgaaattccttctcctggctcatcttggctcaaaagctcccctattgagcaccttgttacccccactcctgcccgccagagaacaacccccctttgatgtaattttcctttacctacccaaatcttataaaacagccccaccccatctcccttcgctgactctctttgcagactcagcccacctgcacccaggtgaaataaacagccttgttgctcacacaaagcctgttttgtggtctcttcacacggatgcgagtgaaatttggtgctgtgactcggatcaggggacctcccttgggagatcaatcccctgtcctcctgctctttattccatgagaaagatccacctatgacctctggtcctcagaccaactagcccaaggaacatctcaccaattttaaatccagtaagtggcctctttttactctcttctccaacctctctcactatccctcaacctctttctcctttcaatcttggcatcacccttcaatctctctcttaatttcagttcctttccttttctgacagagatgaaggagacgcgttttattcatagacccaaaactccggcaccagtcacggaattgggaagacagtcttccctttggaatcaggcagggatgcctgcctgattattcacccatgtttcagaggtgtctgaccatgtggggacacctgccttggtccttcacccttagcgacaagtactgcttttcttgggagcaagaacccccaaccccttctctccgtgtctctactccttctctgcttttctggggggcaagaaccccaccgcttttctccatgtctctaccccttctccgcttttctggggggcaagaaccccccaaccccttctccttcacccttagcggcaagtaccgctcttcttgggggcaagaacccccaaccccttctctccatgtctctactctctcttctctctgggcttgcctccttcactatgggcaagcttccgccctccattcccccttcttctcccttagcctgtgctcttaaaaacctaaaacctcttcaattcacagctgacctaaaacctaaatgccttattttcttctgcaatgccacttgaccccaatacaaactcgacagtagttccacatagccagaaaatgtcactttccatttttccatcctacaagatctaaataattcttgttgtaaaataggcaaacggtctgaggtgcctgacgtccaggcattcttttacacattggtccctccctagtctctgttcccaatgcaactcatcccaaatcttccttctttccctcccgcctgtcccctcagtcccaaccccaagcatcgctgagtctttctaatcttccttttctacaaacccatgtgacctctcgcctcctcaccaggccgagctaggtcccaattcttcctcagcctccacttctccaccctgtaatccttttatcacctcctctcctcacacctggcccagcttacagtttcattccatgactagccctccccaacctgttcagcaatttcctcttaaaaaggtggctggagctaaaggcatagtcaaggttaatgttcctttttctttatcccaaatcagatagcgtttaggctctttttcatcaaatataataacccagcccagttcatggctcgtttggcagcaaccctgagacgctttacagccctagatcctaaaaggtcaaaaggccgtcttattctcaatatacattttattacccaatctgctcccgacattaaataaaactccaaaaattaaattccagtcctcaaaccccacaacaggacttaattaacctcgccttcaaagtgtacaataataaagtagaggcagcaaagtagcaacatatttctgagttgcaattccttgcctccactgtgagacaaaccccagccacatctccagcacgcaagaacttccaaacgcctaaaccacagtggccaggcattcctccaggcctgcctcccccaggagcttgctaaaagtgccagaaatctggccacctggccagagaatgcccgcagcccaagattcctcctaagccatgtcccatctgtgcaagaccccactggaaatcagactgtccatctcaccggcagccactcccatagcccctggaactctgccccaaggctctctgactgactccttcccagatcttctcggcttaacaactgaagactgtcactgcccaatcacctcagaagcctacaggaccatcacagacactctaggtaactctcacagtggagggtaagcccgtccccttcttaatcaatacggaggctacccactccacattaccttcttttcaaaggcctgtttcccttgccttcataactgttgtaagtactgatggccaggcttctaaacctcttaaaactccccaactcttgtgccaacttagacaatactcttttaagcactcctttttagttatccccacctgcctagttcccttattaggctgagacactttaactaaattatctgcttccctaactattcctaggctacagccacacctcattgccaccttttcccccaggtcaaagcctccttcacatcctccccttgtatctccccaccttaacccacaagtataggacacctctactgcctccttagcgactgatcctgcaccccttaccatcccattaaaacctaatcaccttaccccgctcaatgccaatatcctatcccacagcacgctttaaaaggattacagcctattatcactctcctgctacagcatggccttttaaagcctataaactccccttacaattcccccattttacctgtcctaaaaccagacaaggcttacaggttagttcaggatctgtgccttatcaaccaaattgttttgcctaaccaccccatggtgccaaatccatatactctcctatcctcaatatctccctccacaacccattattctgttctgggtctcaaacatgctttctttactattcctttgcacccgtcatcccagcctctcttcactttcacttggactgaccctgacacccatcagactcagcaaattacctaggctgtattgccgcaaggcttcacagacagcccccattacttcagtcaagcccaaatttcttcctcatctcttacctatctcagcataattctcataaaaacacatgtgctctccctgctgatcatgtccggctaatttcccaaaccccaatcccttctacaaaacaacaactcctttccttcctaggcatggttagggcagtcagaattcttacacaagagctgggaccgcaccctgtagcctttctgtccaaacaacttgaccttaccattttagcctagccctcatgtctgcatgcagtggctgccgctgctttaatacttttagaggcccaaaaaatcacaaactatgcccaactcattctctacggttctcataatttccaaaatctattttctttctcccacctgacgcatacactttctgctccctggctccttcagctacactccctttttgttaagtctctgacaattaccattgttcctggcccagacttcaatccagcctcccacagtattctggataccacacctgacccctatgactgtatctctctgattcacctgacattcaccccttttcctcatatttccttctttcgtgttcctcaccctgaacacacttagtttattcatagtagttccaccaggcctaatcgccacacaccagcaaaggcaggctatgctatagtacaagtcaccagcccacctcttagaacctctcatttcctttccatcgtggaaatctatcctcaaggaaataacttctgttccatctactattctactcctcctcatagattattcaggccccctcctttccctacacatcaagctcgaggatttgcccccacccaggactggcaactcttaactccctctcagaggggatagataatctttgctggcaggggaccctccaatactttcaccctgatgaagttctattctttacttttatactcaatcttattctcattcccattcttatgccaccctctacctctccccagctatctccaccacactataaacattactcattctctcctagctgtttctaatccctccttagcgaacaaactctagctttgcatttccctttcttccaatgcctacacagctgtccccaccttacatgcagactaggcaacatctcctgtctcctacacctccaaacttcctttaacagccctcacctttaccctcctgatgaactcatttactttctagacaggtccagctagacctccccagacatttcacgtcagcaagctgccgccctcctccacacttacttaaaaaacctttctccttgtatcaactctactccccccgtatttacctctcacaacacaaactactattcctgtggctgctcctttatgtatctctcagcaaagacccactggaattcccctgggtaacctttcactttgatgttcctttactcttcatctccaaagccctcttgttgtttacttatacccagccccataaataacagtgaaaggtagctcatagacactcaacattttctcatacaccatgaaaatcgaacctccccctctacgcagttaccccaccagtccccattacaacctctgatggctgctgccctagctggatccccaggagtctgggtacaagacacccctttcagcactccttctcatctttttactttgcttctccagttttgcctcgcacaaggtctcttcttcctctgtggatcctctacctccatgtgtctacctgctaattggacaggtacatgcacactagttttccttactcctaaaattcaatttgcaaataggaccgaagagctccctgttcccctcatgacaccgacacgacaaaaaagagttattccactaattcccttgcttatcagtttaagactttctgcctccactattgctctcggtactggaataggaggcatttcaacctctgtcacgaccttccatagcctctctagtgtcttctctgctagcatcacagacatatcacaaactttatcagtcctccaggcccaagttgactctttagctgcagttgtcctccaaaaccgctgaggccttgacttagtcactgctgaaaaaggaggactctgtatattcttaaatgaagagtgttgtttctacctaaatcaatctggcctggtgtatgacaacataaaaaactcaaggatagagcccaaaaacttgccaaccaagtaagtaattatgctgaacccccttggacactctctaattagatgtcctaggtcctcccaattcttagtcctttaatacctgtttttctccttctcttattctgtttagtttttcaattcatacaaaaccgtatccaggccatcacgaataattctaaatgacaaatgtttcttctagcaactccacaatatcaccccttagcatgaaatcttccttcagcttaatctctcccactctaggttcccacatcgcccctaatcccgctggaagcagccctgagaaatatcgcccgttatctctccataccaagcccccaaaatttttgccgtcccaacactttaccactatttcatttttattttcttattaatataaggagacaggaatgtcaggcctctgagcccaagctaaaccatcctatcccctgtgacctgcacatacacatccagatggccggttcctgccttaacagatgacattccactacaaaagaagtgaaaatggtctgttcctgccttaactgatgacattataaaattccttctcctggctcatcctggctcaaaagctcccccactgagcaccttgtggcccccactcctgtccgccagagaacaagccccctttgactgtaatttcccactacctacccaaatcttataaaacagctccacccctatctcccttcgctgactctcttttcggactcagcccacctgcacccaggtgaaataaacagccttgttgctcacacaaagcctgtttggtggtctcttcacacggatgtgagtgaaa

SEQ ID NO: 74 - DNA, 503 bp, Homo sapiens
gtcaggcctctgagcccaagccaagccatcgcatcccctgtgacttgcacgtatatgcccagatggcctgaagtaactgaataatcacaaaagaagtgaatatgccctgccttgccttaactgatgacattccaccacaaaagaagtgtaaatggctggtccttgccttaactgattatattccaccacaaaagaagtgaaaatggctggtccttgccttaagtgatgacgttaccttgtgaaagtccttttcctggctcatcctggctcaaaaagctccccaactgagcaccttgcaacccccactcctgcccaccagagaacaaaccccctttgactgtaattttcctttacctgcccaaatcttataaaacggccccacccctatctcgcttcactgactttctttttggactcagcccgcctgcacccaggggaaattaacagccatgttgctcacacaaagcctgtttggtggtctcttcacacggatgcgcattaaa

SEQ ID NO: 75 - DNA, 6195 bp, Homo sapiens
gacagacaggaccagctggatttcctagactaagaattcctaagcctagctggggaaggtgaccgcgcacccacctttaaacacggggcttgtaactcagctcacacctgaccaatcaggtagtaaagagggctcactaaaatacaaattaggctaaagcaggagataaagaaacagccaaatcatatatcacctgagagcacagggggagggacagtgatcgggatgtaaacccaggcattcgagcagggagcagcaaccccctttgggtcccctcccattttatgggagctctgttttcactctattaaatcttgcaaccgcacactcttctggtccatgtctgttacagctcaagccgagctttcactcgccatccaccactgctgtttgccgccatcgcagacccgccactgacttccacccctccggatatggcaggatgtcttctgtgctcctgatccagcaaggcgcccattgctgctcccaatcgggctaaaggctccccattgttcctgcgtggctaagtgcctgggttctcctaatcgagctgaacactagtcgttgggttccatggttctcttctgtgacccacagcttctaatagagctataacactcaccgcatggcccaaggttccattccttggaatccatgaagccaagaaccccaggtcagagaaaaagaggcttgccaccatcttggaagcagcccaccaccatctcgggagctctaagaacaaggaccctcccagtaacattttggtgaccatgaagggacatccaaagtggtgagtaatattggaccacttttacttgctattctgtcctatccctaccatacaaaggtctgaccagacctaggaggaactcccttcaggacaggacgatagatggttgctcccaggtgattgagaaaaaaaccacaatgggtattcactaattgatagggagactcttgtggaagcagaattaggagaattgccaaataattggtctgctcaaacgctggagctgtttgcactcagccaagccttaaactgcttaaagaatcaaaaaactctatctcaatcctgactcaaaaggttacctacaccctctctgaaacgaatttgcataagaactgttgtttgtgggaatgcatcttaatggggcaactgggttgttatgaaatactctggaacccaccccagctctaggactcaccactgagcacaaaggcaatgttgggcatgctggtaaaggaccactggagtccagcagcccagacccctttctttgtgatcaaggaaggtgggaaaaggggtgcaggactgctacatggtgagtgtaactaatccgataagcagaggtccatgggtggttatgcaccctggaaaggaataagcattaagaccatagaggacgctctaggactaatgctcatcggaaaatgactaggggtgctggcatccctgtgatttttttgttttgttttttgttttgttttttttttcagatgggaagcattccccctaaggcaaatgcccctaagatgtattctggagaatttggcccagtcagagtgtatgtacctttttccctgtcagacttaaagcaaattaaaataggcctaggtaaattctcaaataaccctgatatctatattgacattttacaagggttaggacaaaactttaatctgacatgagagatataatgttactgctagatcagacactaaccccaaataagagaagtaccaccataactgcagcccacgagtttggcgatctcgggtatctcagtcaggtcaatgaaaggatgacaacagaggaaagagaacgattctccacaggccagcaggcagttcccaatgtagaccctcattggaacgcagaatcagaacatggagattagtgcagcagacatttgctaacttgcgtgctagaaggactaaggaaaactaggaagaagcctatgaattattcaatgatgtccactataacacaggaaaaggaagaaaatcctactgcctttctggacagactaagggaggcactgaggaagcatacctctctgtcacctgactctattgaaggccaactaattttaaaggataagtttatcactcagtcagctgcagacattaaagaaaaacttcaaaagtccaccttaggcccagagcgaaacttaaaaaccctattgaacttggcaacctctgttttttataatagagatcaggaggagcaggcggaacgggacaaacgaggtaagaaaaaggccaccactttagtcatggccctcgggcaagcggactttggaggctctggaacgcggaaagcctgggcaaatcgaatgcctaatagggcttgcttccagtgcggtctccaaggacactttaaaaaagattgtccgaatagaaataaaccgcccccttgtccatgccccttatgtcaagggaatcactggaaggcccattgccccaggggatgaaggtcctctgagtcagaagccactaaccagatgatccagcagcaggacagagggtgcccggggcaagcgccagcccatgccatcaccctcacagagccccgggtatgtttgaccattgagggccaggaggttaaccatctcctggacattggcgtggccttcttagtcttactctcctgtcctggacaactgtcctccagatctgtcactatctgaggggtcctaggacagccagtaactagatgcttctcccagccactaagttgtaactggggaactttactcttttcacatgcttttctaattatgcctgaaagccccactcccttgttagggagagacattctagcaaaagcagaggccattatacacctgaacacaggagaaggaacactcgtttattgttccctgcttgaggaaggaattaatcctgaagtctgggcaacagaaggacaatatggatgagcaaagaatgcctctcctgttcaagttaaactaaaggattccgccccctttccctaccaaaggcagtacccccttagacctgaggcccaacaaggactccaaaagattgttaaggacctaaaagcccaaggcctagtaaaaccatgcagtagcccctctgatactccaattttaggagtacagaaacctaatggacagtggaggttagtgcaagatctcagtattatcaatgaggccattgtccctctataccaagctgtacctaacctttacactctgctttcctaaataccagaggaaggagagtggtttacagtcctggaccttaaggatgctttttcctgcatcctgtatatcctgactctcaattcttttttgcctttgaagatccttcgaacctaatatctcaactcacctggttcacggatagcccccatctaattgtccaggcattagcccaagacttgagccagttttcatacctggacactcttgtcctttggtacatggatgatttacttttagccacccattcagaaaccttgtgccatcaagccacccaagcactcttaaatttccttgccacctgtggctacaagatttccaaaacaaaggttcagctctgctcacagcaggttaaatacttagggctaaaagtatccaaaggcaccagggccctcagtaaggaatgtatccagcctatactggctcatccttatcccaaaaccttaaagcaactaagagggttccttggcataacaggcttctgccgaatatggattcccaggtacggcgaaatagccaggccattgtatacactaattaaggaaactcagaaagccaatacccatttagtaagatggacacttgaagcagagcagctttccaggccctaaagaaggccctaacccaagccccagtgttaagcttgccgacggggcaagacttttctttgtatgtcacagaaaaaaacaggaatagctctaggagtccttacacaggtccaagacaccagcttgcaacctgtggcatacctaagtaaggaaaatgatgtaacggcaaagagttggcctcattgtttatgggtagtggcagcaatagcagtcttagtatctgaagcagttaaaataatacagggaagagatcttactgtgtggacatctcatgatgtaaacggcatactcactgctaaaggagacttgttgctgtcaggcaaccgtttgcttaaatatcaggctctattacttaaagggccagtgctgtgactgcgcacttgtgcaactcttaacccagccacatttcttccaaacgataaaagatagaacataactgtcgacaggtgattgctcaaacctacaccactcgaggggaccttctagagtttcccttgactgatcccaacctcaacttgtatactaatggaagttctttgtagaaaaaggacttcaaaaagcagggtatgcagtggtcggtaataatggaatacttgaaagtaatcccctcactccaggaactagcactcagctggcagaactaatagccctcactagggcactagaattaggagaagaaaaaagggtaaatatatatacagactgtaagtatgcttacctacttctccatgaccacgcagcaatatggagagaaagggaattcctaatttcagagggaacacctatcaaacatcgggaagccattaggagattattcttggctgtacagaaacctaaagagatggcagtcttacactgctggggtcatcagaaaggaaaggaaagggaaatagaagggaactaccaagcggatattgaagccaaaagagccacaaggctggaccctccattagaaatgcttatagaaggacccctggtatggagtaatcccctcaaggaaacaaagcaccagtactcaacagaagaaatagattggggaacctcacaaggacatagtttcctcctctcgggagggctagccaccgaagaaggaaaaatagttttgcctgcagctaaccaatggaaattacttaaaacgcttcaccaaatctttcactctcactgcacctcctccatgccgctgtactaccagtagctccccttaccaagagcttctatggagaaatgtggcttcccagaaatattgatgccccattgtataggagtttttctaaaggaaaccccactttcactgcccacactcatatgcccttgcacttcaggccatacatttcaatccctgtatctttaacctccttgttaagtttgtctcttccagaattgaagctgtaaaactacaaatggctcttcaaatggagccccagatgcagtccatgactaagctctactgcggacccctggactggcctgctagcccatgctctgatattaatgacatggaaggcaccccccctgaggaaatctcaactgcacgacccctactatgccccaattcagcaggaagctgttaacagcggtcattggccaacctccccaacagctcttgggttttcctgttgagagggggaactgagagacaggactagctggatttcctaggccgactaagaattcctaagcctagctggggaaggtgaccacacccacctttaaacacggggcttgtaactcagctgacacccaaccaatcaggtagtaaagagggctcactaaaatacaaattaggctaaagcaggaggtaaagaaacagtcaagtcatatatcgcctgagagcacagggggaaggacagtgatcaggatgtaaacccaggcattcgagcagggagtggcaaccccctttgggtcccctcccattttatgggagccctgttttcactctattaaatcttgcaactgcacactcttctggttcatgtttgttacagatcaagctgagctttcactcgccatccaccactgctgtttgccgccattgcagacctgccactgacttccacccctccggatctggcaggatgtctgctgtgctcctgatccagcgaggtgcccattgccgctcccgatcgggctaaaggctcaccattgttcctgcatggctaagtgcctgggttctcctaatcgagctgaacactagtcgctgggttccacggttctcttccgtgacccatggcttctaatagagctataacactcactgcatggcccaaggttccattccttggaatccatgaggccaagaaccccaggtcagactacaagaggcgggctgccatcttgggagcagcccgccatcatcttgggag

SEQ ID NO: 76 - DNA, 80 bp, Homo sapiens
tgactcccttttccgattcagcccactaacacccaagtgaataaacggccttgttgctcacacaaagtctgcttgggtct

SEQ ID NO: 77 - DNA, 5537 bp, Homo sapiens
gtcaggcctctaagcccaagctaagccatcataaaccctgtgacctgcacatacacatccagatggccggttcctgccttaactgatgacattccaccacaaaagaagtgaaaatggcctgttcctgccttaactaatgacactatcttgtgaaattctttctcctggctcttcctggctcaaaagctcccctaatgagcaccttgcgacccctactcctccaaccagagaacaacccccctttttcctttacctacccaaatcctataaaacggccccactcctatctccctttgctgactcccttttcagactcccttttcacctgcacccaggtgaaataaacagccttgttgctcacacaaagcctgtttggtggtctcttgacatggacgcgcatgaaatttggtgctgtgactcagatggggggacctcccttgggagatcaatcccttgtcctcctgctctttgctccatgagaaagatccacctatgtcctcaggtcctcagaccgaccagcccaagtaacatctcaccaatttcaaatctggtaagtagcctctttttactcttttctccaacctccctcactatccctcaacctttttctcctttcaatcttggcaccacacttcagtctctcccttctcttaatttcaattcctttcattttctggtagaggcaaaggagacatgttttatcaatggacccaaaactccggcgccggtcacggactagggaaggcagccttcccttggtgtttaatcactgcagggacacctctctgattattcacccaggtttcagaggtgtcagaccacacagggacacctgccttggtccttcacccttagcggcaagtcccgcttttctgggggagaggcaggaaccccgacctcttatctctgcaccctgatcccttatttccataccgtgacctcttatctccatgccctgaccccttctctgcttttttggagggcaagaactccccaccccttctccgtgtctctactcttttttctctgggcttgcctccttcactatgggcaaccttccaccttccattcctccctcttctcccttagcctgtgttcttaagaacttaaaacctcttcagctctcacctgacctaaactctaagcatcttattttcttctgcaatgccacttgaccccaatacaaactcgacagtagttccaaatagccagaaaacggcactttcaatttttccatcctaccagatctaaataattcttgtcgtgaaatgggcaaatggtctgaggtgcctgacatccaggtgttcttttacacatctgtctctccctagtctctgttcccaatgcacctcatcccaaatcttccttctttccctcccacctgtcccctcagtcccaaccccaagcatcactgagtctttctaatcttccttttctacagacccatctaacctctcccctcctcgccaggctgagctaggtcccaattcttcctcagcctccactcctccaccctataatccttttatcacctgccctcctcacacccggtctggcttactgtttcgttccatgactagccctcccccacctgtccagcaatatcctcttaaaaaggtggatggagctaaaggcctagtcaaggttaatgctcctttttctttatcccaaatcagatagcgtttaggctctttttcatcaaatataaaaacctagcccagttcatggctcgtttggcagcaacactgagatgttttacagccctagactctaaaaggtcaaaaaaccgtcttattctcaatatatattttattacccaatctgctcccgacattaaataaaactccaaaaattaaattccggccctcaaatcccacaataggacttaattaacctcaccttcaaggtgtacaattccttgcctccgctgtgagacaaaccccagccacatctccagcacacaagaacttccaaatgcctcaatcacagtggccaagtgttcctccaggcccgcctcccccaggagcttgctacaagtgccagaaatctggccaccaggccaaggaatgcctgcagcctgggattcctcctaagctgtgtcccaactgtgcaggaccccactgaaaatcagactgttcaatttacctggcagccactcccagagcccctgaactctggcccaaggctctctgactacttcccagatcttctcggcttagcagctgaagactgatgctgcctgatcgcctcagaagcccctagacgaccatcacagatgccgagcttcgggtaactctcacagtggagggtaagtccgtccccttcttaatcaatacggaggctacccactccacattaccttcttttcaagggcccgtttcccttgcctccataactgttgtgggtattgacagccaggcttctaaacctcttaaaactccccaactctggtgccaacttagaagacactctttttgcactcttttttaattatccccacctgcccagttcccttattaggccgagacactttaactaaattatctgcttccctgactactcctgggctacagccacacctcattgccaccttttcccccagttcaaagcctccttcacatcctccccttgtatctccccaccttaacccacaagtataagacacctctactccctccttagtgactcatcatgcaccccttaccatcccattaaaacctaatcactcttaccctgctcaatgccaatatcccatcccacagcacactttaaaaggattagagcctgttatcactcgcctgttacagcatggccttttaaagcctataaactccccttacaatttccccattttacctgtcctaaaaccagacaagacctacaggttagttcaggatctgcgccttatcaaccaaattgttttgcctatccaccctgtggtgccaaacccatatactctcctatcctcaatacctccctctacaacccattattctgttctggatctcaaacatgctttctttactattcctttgcactcttcatcccagcctctcttcgctttcacttggactgaccctgacacccattaggctcagcaaattacctgagctgtactgccgcaaggcttcacagacagccccctttacttcagtaaagcccaagtttcatcctcatctgttacctatctcagcataattctcataaaaacacacgtgctctccctgctgatcgtgtccagctaatctcccaaacctcaatcccttacaaaacaacaactcttttctttcctaggcacggttagtgcagtcagaattcttacacaagagctgggaccgcaccctgtagcctttctgtccaaacaacttgaccttactgttttaggctggccatcttgtctccgtgcagcagctcctgctgccctagtacttttagaggcccttaaaatcacaaactatgctcaactcactctctacagctctcataatttccaaaatctattttcttcctcacacctgacgcatatactgtctgctccccggctccttcagctgtactcactctttgttgagtctcccacaattacaattgttcctggcccggacttcaatccggcctcccacattattccagataccacacctgaccctcatgactgcatctctctgatccacctgacgttcaccccatttccttcttccctgtttctcacgcagatcacacttggtttattgatggcagttccaccaggcctaatcgccacacaccagcaaaggcaggctatgctatagtacaagccactagcccgcctcttagaacctctcatttcctttccatcgtggaaatatatcctcaaggaaataacttctcagtgttccatctgctattctaccactcctcagggattattcaggccccctcccttccctacacatcaagctcagggatttgtccccaccaaggactggcaaatttgctattctactacttctcagggattattcaggcccctcccttccctacacatcaagctcagggatttgcccccgcccaggactggcaaattagctttactcaacatgccctgagttaggaaactaaaatacctcttggtctaggtagacactttcactggataggtagaggactttcccacagtgtctaagaaggccaccatggtcatttcttcccttctgtcagacataattcctcggtttggccttcccacctctatacagtccgatagcagactggcctttattagtcaaatcagccaagcattttttcaggctcttagtattcagtgaaacctttatatcccttacagtcctcagtcttcaggaaagaacagaataatggtcttttaaaaacacacctcaccaagcttagccaccaacttaaaaaggactggacaatacttttaccactttcccttctcagaattcaggcctgtcctcagaatgctaaaaggtacagcccatttgagctcctgtatagatgctcctttttattaggccccagtctcattccagacactagaccaacttggactgtgccccagaaaacttgccatctctactatcttctgtctagtcatactcatattcaccgttctcaactactcatacctgccctgctcttgtttacactgccagtttacactgtttctccaagccatcacagctgatatctcttggtgctatccccaaatcgccactcttaactcttgaagtaaataaataatctttgctggcaaggctatactgaaccttcttaggcactctttacttaaatgtcctaggtcctcccaattcttagtcctttaatacctgtttttctccttctcttatcccatttagtttttcaattcatataaaactgtatccaggccatcaccaataattctaaatgacaaatgtttcttctaacaaccccataataccaccccttaccacaaaatcttccttcagtttaatctctcccactctatgttcccacgccacccctaatcccactggaagcagccctgagaaacatcgcccattaactctccataccacccccaaaattttcaccatcccaacactttaccactatttcattttatttttcttattaatataagaagacaggaatgtcaggcctctgagcccaagctaagccatcatatcccctgtgacctgcacatacacatccagatggccagttcctgccttaactgatgacattccaccacaaaagaagtgaaaatggcctgttcctgccttaactgatgacattatcttgtgaaattccttctcctggctcatcctggctcaaaagctcccctactgagaaccttgtgaccccccactcctccaaccagagaacaacccccctttttcctttacctatccaaatcctataaaacggccccaccccatctcccttccctgactctattttcagactcagcccacctgcacccaggtgaaataaacagcctgttgctcacacaaagcctgtttggtggtctcttcacatggaagcgcatgaaa

SEQ ID NO: 78 - DNA, 5548 bp, Homo sapiens
gtcaggcctctgagcccaagccaagccatcgcaacccctgtgacttgctcgtatatgcccagacggcctgaagtaactgacgaatcacaaaagaagtgaaaaggccctgccccgcattaactgatgacattccaccattgtgatttgttcctgccccaccttaactgagtgattaaccctgtgaatttccttctcctggctcagaagctcccccactgagcactttgtgaccccctgcccctgcccaccagagaaccccctttgactgtaattttccattaccttcccaaatcctataaaacggccccacccctatctcccttcgctgactctcttttccgactcagcccgcctgcacccaggtgaaataaacagccatgttgctcacacaaagcctgtttggtggtctcttcacatggacgcgcatgaaatgtggcgcatgaaatttggtgccgtgactctgatcgggggacctcccttgggagatcaatcccccgtcctcctgctctttgctccgtgagaaagatccacctatgacctcaggtcctcagactgaccagcccaagaaacatctcaccaatttcaaatccggtaagcggcctctttttactctcttctccaacctccctatccctcaacctctttctcctttcaatcttggcgccacacttcaatctctccattctcttaatttcaattcctttcattttctggtagagacaaaggagacacgttttatccgtggacccaaaactccggcgccggtcacggactgggaaggcagccttcccttggtgtttaatcattgcagggccacctctctgattattcccccacgtttcaaaggtgtcaaaccacgcagggacacctgccttggtccttcacccttagtggcaagtcccgcttttctcggggaggggcaagtaccccaaccccttctctccgtgtctctaccccttctctgctcttctggggcaggagcaagaacccctcaaccccttcttcaccgttagtggtaagtcccacttttctagggggcaagaacccccaatcccttatttccatgccccaaccctttctctgcttttctgaagggcaagaaacccccgccccttctccgtgtctctactcttttctctgggcttgcctccttcactatgggcaagtttccaccctccattcctcctccttctcccttagcctgtattcttaagaacttataaacctcttcaactctcacctgacctaaaatctaagcgtcttattttcttctgcaatgccgcttgaccccaatacaaactccacagtagttccaaatagctggaaaacggcactttcaatgtttccatcctacaagatctaaataattctagtcgtaaaatgggcaaatggtctgaggtgcctgatgtccaggcattcttttacacatcagtcctttcctagtctctgtgcccagtgcaactcgtcccaaatcttccttctttccctcccacctgtcccctcactcccaaccccaagcattgctgagtctttctaatcttccttttctacagacccatctgacctctcccctcctcgccgggccgagctaggtcccaattcttcctcagcctccgctcctccaccctataatccttttatcacctcccctcctcacacctggtccagcttacagtttcgttctgtgactagccctcccccacctgcccagcaatttactcttaaaaaggtggctggagccaaaggcatagtcaaggttaatgctttttctttatcccaaatcagaagcgtttaggctctttttcatcaaatataaaaacacagcccagttcatggcttgttcggcagcaaccctgagatgctttacagccctagaccctaaaaggtcaaaaggccatcttattctcaatatacattttattatccaatctgctcccgacattaaataaaactccaaaaattggaatctggccctcaaaccccaaaacaggacttaattaaggtgtacaataataaaaaaaagttgcaattccttgcctccactgtgagacaaaccccagccacatctccagcacacaagaacttccaaacgcctgaaccgcagcggccaggcgttcctccagaacctcctcccccaggagcttgctacaagtgccagaaatctgaccaccaggccaaggaatgcctgcagtccaggattcctcctaagccgtgtcccatctgtgcaggaccccactggaaatcggactgttcaactcacctggcagccactcccagagcccctggaactcttgcccaaggctctctgactgactccttcttggcttagcggctgaagactgacgctgcccgattgcctcggaagccccgtagaccatcacagatgccgagctttaggtaactctcacagtggagggtaagtccgtccccttctcaatcaatacggaggctacccactccacattaccttcttttcaagggcctgtttcctttgcctccataactgttgtaggtattgacagccaggcttctaaacctcttaaaactccccaactctggtgccaacttagacaatactcttttatgcactcatttttagttatccccacctgcccagttcccttattaggccgagatattttaaccaaattatctgcttccctgactattcctggactacagctgcatctcattgccgcccttcttcccaatccaaagcctcctttgcatcctcctcttgtatccccccaccttaacccacaagtataagatacctctactccctccttggtgaccgatcatgcaccccttaccatctcattaaaagctaatcacccttacccggctcagtgccaacatcccatcccacagcatgctttgaaaggattaaagcctgttatcactcgcctgctacagcatggccttttaaagcctataaactctccttacaattcccccattttacctgtccaaaaactggaaaagccttacaggttagttcaggatctatgccttattaaccaaattgttttgcctatccaccccatggtgccaaacccatatactctcctatcctcaatacctccctccacaatccattattctgttctggatctcaaacatgctttctttcctattcctttgcacccatcttcccagcctctcttccctttcacttggactgaccctgacacccatcaggctcagcaaattacctgggctgtactgccgcaaggcttcacagacagaccccattacttcagtcaagcccaaatttcatcctcatctgttacctatctcggcataattctcgtaaaaacacatgtgctctccctgctgttcgtgtccgattaatctcccaaacctcgatcccttacaaaacaacaactccttcccttcctaggcatggttagtgcggtcagaattcttacacaagagccaggaccgcaccctgtagcctttctgtgcaaacaacttgaccttactgttttagcctagccctcatgtctgcgtgtagcggctgccactgctttaatactattagaggccctcaaaatcacaaactatgctcaactcactctctacatttctcataacttccaaaatctattttcttcctcacacctgacgcatatactttctgctccctgactccttcagctgttctcactttttgttaagtcccacaattaccattgttcctggcccggacttcaatccagcctcccacattattccggataccacacctgacccccatgactgcatctctgtgatccacctgatgttcatcccatttccccacatttccttcttccctgttcctcaccctgatcacgcttgatttattgatggcagttccaccaggcctaatcgccacacaccagcaaaggcaggctatgctatagtacaagccactagcccgcctcttagaacctttcatttcctttccattgtagaaatctatcctcaaggaaataacttctcagtgttccatctgttattctactactcctcaaggattattcaggccccctcccttccctacacatcaagcttgagcatttgccccagcccaggactggcaaattagctttactcaacatgccccgagtcacaaaaactaaaatacctcttagtctaagtagacactttcactagatagggagaggcctttcctacagggtctgagaaggccaccacagtcatttcttcccttctgtcagacataattcctcagtttagccttcccacctctatacagtctggtaacagactagcctttattagtcaaatcagccaagcattttttccagctcttagtattcagtgacagactaatggtctattaaaaacacacctcaccaagctcagccaccaacttaaaaaggactggacaatacttttaccactttcccttctcagaagtcagacctgtcctcagaatgctacaagctacagcccatttaagctcctgtatagacgctcctttttattaggccccagtctcattccagacaccagaccaacttagactgtgcccccgaataacttgtcatccctactatcttctgtctagtcatactcctattcaccgttctcaactactcatacatgccctgctcttgtttacactgccagtttacacagtttctccaagccatcacagctgatatctcctcatgctatccccaaactgccactcttaactcttgaagtaaataaataatctttgctggcaggactatgctgaatctccttaggcactctctaatcagatgtcctaggtcctcccaattcttagtccttttatacctgttttgctccttttcttattccatttagtttttcaattcatacaaaaccgtatccaggcgatcaccaatcattctatacgacaaatgtttcttctaacatccccacaatatcacccctttccacaagatctcccttcagcttaatctctcccactctaggttcccacgccgcccctaatcccgcttgaagcagccctgagaaacatcgcccattctctcttcataccaccccccaaaaattttcgccaccccaacacttcgacactattttatttttcttattaacataaggcaggaatgtcaggcctctgagcccaagccaagccatcgcatctcctgtgacttgcacgtatacacccagatggcctgaagtaactgaagaatcacaaaagtgaaaaggccctgccccgcattaactgatgacattccaccattgtgatttgttcctgccccaccttaactgagtgattaaccctgtgaatttccttctcctggctcagaagctcccccactgagcactttgtgaccccttcgcccctgcccaccagagcacaaccccctttgacagtaattttccattaccttcccaaatcctataaaatggccccatccctatctcccttcgctgactctcttttctgactcagcccgcctgcacccaggtgaaataaacagccatgttgctcacacaaagcctgtttggtggtctcttcacacggacgcgcatgaaa

SEQ ID NO: 79 - DNA, 7621 bp, Homo sapiens
tggatgagatgcaaagtaagcccactccattatggactgtgttaaagaatttccaaaaacattttaatggagattatggggttactatgaccccaggaagacttaggaccttgtgtgagatagattggccacattagaagtgggttggccatcagaaggaagcctacacagtccctagtctcaaagttatggcagaaggtaactggtaagccaggactcccaggccagtttccgtagacacttggctacagctggttttagactcgccacagtggttaagaggacaggcagcagcagtactagtggcaaaaggacagagagccaaggaagaatcccgctccacccgccgagagaagtcggctcctaaagtcctgtccgacccaacattagaggattcatggcaacaaacagcaccagtgcccacccgccccttcaccaagaaggaaggcctcccacccgagcttccacaaggcctacatacccctagaccacccagagtagaaaagaaaggatgcaagaccttggaagaaacctcgcccttggcagcccgtttgaggcctagaactgggatacaaaagcccctgaaagagcaacagtatactggggtagacgaggatggccatatggtggaaatgtgtgcctttgtgtaccaacccttcacctctgccagtctcctcaattggaaaaacaatacgtcatcctatactgaaaagcctcaagctataattgatttgctccaaactattacccagacccacaaccctacttgggttgattgccaccagttgctcatgtacctatttaactcagatgaaaggtgaagggtgctccaggcagcaactaagtggctagaggaacatgttctggctgattacccaaacccccaagagtatgtgaggatccaattaccaggaacagacccccagtgggacccaaatgaaagacagggtatgcaaaggctaaaccggtacagggaagcccttctggaaggcttaaaaaagagacctcaaaggccacaaatgttaacaaagtcattcaaggaaaagatagagtctggcacaattctatgagagactatgtgaggcctatcgtacatatactccctctgatcccgatagccctgaaaatcagcgcatgattaacatgactttggttagtcaaagtgcagaacacattagaagaaaactacagaaacaggctgggtttgcaggtatgaatacttcacagttattggagatagccaaccaggtgtttgtgaatagagatgcggtaagccacagagagaaccacagagagagcaaatgccaagcccagtgaaacgccgacctgctagctgcagctattagaggggttcccccgaaggagcaagagaaggggggcctggggaaaaatacccagtctggccatccatgcttgcagcgtaaccagtgtgcttactgtaaggaaataggacattggaaggacaagtgcccacagttgaaagggaaacaaggtggctctgagcaggaggcctcagacaaggacgaaggggccttgttcaatctggcagaagggttactggactgagggggaccgagctcatgtgaccccaaagagcccatggtcaggatgacagtcgggggcaaggacattgagtttcttgtcaatactgttgctgaacattcagtattaaccatcccggtcacccccttatccaaaaaaactattgatataatcggagccccaggggtttcggcaaagcaaactttctgtttgccccagacctgcactgtgtggggcatgaagcgattcaccagttcctgtacatggctgactgccccttgcctttactgggcaagggacctacttagcaagcggagagccactatctcttttacaaagcatggctctttacagctaaagttacctggaatgggagtcattgtgtttcttacggttccttgggaggaggaatggagactcttcttaactgagccaggccaagagataggaccagctctggctaagcggtggccaagggtgtgggtggaagacaaccctccaggtttggcaatcaaccaggcccctgtacttagaagctaagcctggggcccagccattcaggcaaaagcagtaccaggtccccagagaaaccattgagggcatccaggtccatctcaagcacctgagggcctttggaattatagtcccatgtcagtcccctcctacctgttcccaagccagggaccagggactacaggccagtacaggatttgtgcttggtcaaccaagctacagtgactttgcacccaacggtacctaacccatacacattgttggggttgctgccagctgaggacagctggttcacctgctttgacctaaaagactctttctttagtatcaaactagcccctgagagccaaaaactgtttgcctttcagtgggaggatctggggtcaggtgtcaccactcagtacacttggacccagctcccccaagggttcaagaactcccccaccatctttggggaggtgctggcttgagacctccagaagtttcccaccagagacctaggctgcgtgctgctccattaggtcaacgacctctgctgggacaccccacggcagtcgggtgtgccaagggaatgaataccctgctccagcacctagaagactgtgggtataaggtgtccaagaagaaagctcagattgcagacagcaggtacgttatctgggatttactatccgacagggagagcgcagcctgggatcagaaagaaagcaagtcatctgcaacctgtcagagcctaagaccagaaggcaggtaagagaattcttaggagctccagggttctgcaagttgcagatctcaaagtttgcagtattggctaagcccctgtacagagacacaaagcggggagacaaggaaccttttgaatgggagtcccaacagcaatgagcttttcatgagttaaaagagaagctcttgttggcctcagccctggggctacctgacctaacaaaaccttttacactgtatgtgtcagaaagagaaaaaatggcagttggagttttaacccagatgatggggctctggccaagaccgatagcctacctctccaaacagctagatggagtttctaaggttggcccccatgcttaagagccttggcagcaactgccctgttagtacaagaggcagataagctaactgttgggcaaaacctaaacataaaggccccccatgctgtggtaacactaatgaacatcaaaggacatcattggttaacgaatgctagactaactaggaaccaaagcttgctctgtgacaattcccgcataaccattgaagtttgcaacaccctgaaccctgtcaccttgctcctgatatcagagagcccagttgaacataactgtgtagaggtattggactcagtttattctagcaggcccaacctccgagaccatccttggacatcactagactgggagctatacatggaagggagcagcttcgtcaacccaaggagagaggtgtgctggatatgcagaggtaaccctggacggtgtcattgaagccaaattgttgccccagggtactttagcccagaaggcagaactcattgctttaattcaggccttagagctaagtgaaggtaagactaaacatttacactgactctaggtgtgcctttttaactcttcaagtgcatggggcattatacaaggaaaaaggcctattgaactctgggggacaagatgtaaagtatcagcaagagatcctgcaactattagaggcagtgtggaagccccaaaaggtggcagtcatgcactgcagtagacaccagtgagattctaccttgattgccttggggaactcccaagctgactcagaggctcaaaaagcaacatccacaccctaccgggcatcagtcacagcatcccctgctccctcaggaacctgaccttgtacatacttattctaaagaagagaagtactttctccaggcagagggagggcagatgatagaagagggatggatccagtaattggacagaagaatagctgtgccacaactgctaggagccaccgtcgtactggctgtgcatgagaccaccctcctaggccaagagtcacttgaaaagttgttaggccagtatttctaaatctcgcatctgtcagcccttgccaaaacagtggcgcagccatatgttacctgctggcagcacgatgctaggcaaggtccaaccattctgcccatcatacaagcttatggagcagcccccttggaagatctccgagtagacttcaccaagatgcccaaatgtggaggtaaaaagtatttgctagttctagtgtgtacgtactctgggtgggtggaggcctatccaacatgaactgagaaaactcgtgaagtaacccatgtgcttctccaagatctcatgcctaggtttggactgcacttacgaatcagcttggacaatgggccggcgtttgtggctgacttggtacagaagacagctaaggtattggggatcacatggaaactacataccgcctaccaaccacaaagttccggaaagggagcagatgaatcagactaccaaaacataatttagtgaaagtgtgtcaagaaacagggttaaggtgggtacaagctctccctgtggtattgtttaagattagatgtaccccttctaaaagaacaggctattctccttatgaaatattatatcataggccccctcccatactatggggactcccaggtactcctcgagacctaggtgaaattgagttacagagacagctacaggcttcagggaaaattacacaaacaatttcagcctgagtaaatgagagatgccccatcagcttattctccccagttcaccctttctccccagggtgtggatcaaggattagaacgtaacccccttgtggccatggtggaaaggaccccagactgtcgtcttgaccacagccataaaggtagagggaatcccagcctggatccaccacagccacgttaaacctgcagcacctgagacctgggaggtaagaccaagcccggacaacgcctgcaaagtgactctgaagaagacgacaagccctgctgcagtcacacccggaagctgactggtccacacacggccgaagcatgaggaaactcatcttgggactccttttccttaaactttggacttatagagtaaggacttcaactgaccttcctcagactgaggacaattcccagcatatatatcaagtcactgagataggacaaaaggttgctgtagtccattattttatagttattatgagtgtaccgggactctaagaggaacttgtttgtataatgctactctatacaaggtatgtagcccaggaagtgaccagcctgatgtgtgctctaacccatctgagcctcctatgactaccatttttgaaataagattgaggactgggagctggggaaaagctgatatgagtagagtagtaactagaatagaagagaaaggagtccccaaacaaattttcttaaaatttgatgcctgtgcagcaatcaacagtgacctgtatggaaatagaataagatgtagctctctagattgggaaaggggctatatagtagaaaataagtatgtttgtcatgaattaggactatgtactgatgaatgtagttactggtcctgtgttatttaggccacctggaaaaaaatatgagaaggaccctgtcctccttcaaaaaggaaagagtaactcttcatgcacttgtggttactgtaacctattagaactactaattaccaatccccttgatccccattggaaaacaggagagtatgtaaatttaggaatcaatggaactggactggatccctgagtaaatattttagtccaaggggaggtccacaggctctctcccaaaccagtgtttcagacattttatgatgagctgaatctgccagcaccagagcttccacaaaaaagaaaagaacttgtttctccatttagcagaaaatgtagctcatttcctcaatgttacttcctgttacatatgtgggggaaccactatgggagaccgatggccttgggaagcccgagaattggtgcctactgatccagttcctgacataattccagtccagaagacttctgggtcttgaaaacctctattactgaacaatactgcatagctagggaatgaaaagacttcaccatccctgtaggaaggctcaattgtctaggacagaggtctaggacagaggctgtataacggcacaacagggacagtcacctggtggggtctaaaccatactgaaaagtatgtaaatttccttcattacattccttcagtaaatttcctaaattacagattgcttggcccatccacaatctcatcgagactggacggctcctactggactatactggatatgtaggcacagagtctacactcagttacctgatcaatggccaggtagttgtgtcattggcaccagtaagccatccgttttcctactgcccgttagaacaggtgagctcttaggtttccctgtctatgtctcccgagaaaagaggagcatagctataggaaattggaaaggtgatgagtggcccccccccgaaaggatcacacagtactataggcctgccacatgggcacaagatggcttgtggggatactgagcccctatctacatgctcaactggatcatactgttacaggccatcttagaaataatcactaaagaaactggcagagctttgactcttttagcccagcagaaaccccaaatgagaaatgccatctagcagaatagattggccttagactatttgctggcagctgaaggaggagtctgtggaaaattcaacttgaccaattgctgtctgcaaatagatggtcaaggacaagtagtcgaaaatatagttagagacatgacaaagctggcacatgtacccatgcaggtttggcatgggtttgatccttgatccctgtttggaaaatagtttccagctctaggaggatttaaaacttttataataggaataataatagtgttaggaacatgcatgttactcccctgtatgttacccatatttctaccaccttagttcatcaaaagacctcagcacaagtatattacatgaatcactatcgatatgtctcacaggaagatctagatagtgaggatgagaatgagaactcccactagtgtgtgaggttctcaaagaggggtattaggagacaagccatttctcctactgtcccctgtatccaaagaaaaggaggaagtaaaaactgaaaaataacagactgatcagtgccactggccaggcctgtaggttaaagattaaccccaccctaactgcttgtgctatctatagatcacagataatggtatggagaaatacttgccttgctcaccacccccacctagtcatgtaccacatgcttgctcaatatatcgtgaccctttcacgtgaaccccttagagttgtaagcgggaactctttttttggggagttcagttcttgagacacaagtctgccaacactcctggccaaataaagcctcttccttctttaacccggtgtctgagggcatttgtctgtggctcgtcctgctaca

SEQ ID NO: 80 - DNA, 3720 bp, Homo sapiens
gtcaggcctctgagcccaagccaagccatcgcatcccctgtgacttgcaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatgaaatttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccggtaactctcacagtgcaaggtaggcccgtccccttcttaatcaatacggaggctactcactccccattaccttcttttcaagggcctgtttcccttgcctccataactgttgtgggtattgacggtcaggcttctaaacctcttaaaactccccaactctggtgccaacttagacaatactcttttaagcactcctttttagttatccccacctgcccagttcccgtattaggctgagacactttaactaaattatctgcttccctgactattcctggactacagctatatctcattgccgcccttcttcccaatccaaagcctcctttgcgtcctcctcttgtatcccccgaccttaacccacaagtataagatacctctactccctccttggtgaccgatcatgcaccccttaccatctcattaaaacctaatcacccttaccccactcaacgccaatatcccgtcctgcagcatgctttaaaaagattaaagcctgttatcactcacctgctacagcatggccttttaaagcctataaactctccttacaattcccccgttttacctgtcagccctgagaaacatcgcccattctccctccataccaccccccaaaaattttcaccgctccaacacttcaacactattttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctgccccaccttaactgagtgattaaccctgcgaatttccttctcctggctcagaagctcccccactgagcaccttgtgacccccgcccctgcccaccagagagcaaccccctttgactgtaattttccattaccttcccaaatcctataaaacggccccacccctatctcccttggctgactctctttgcggactcagcccgcctgcacccaggtgaaataaacagccatgttgctcacacaaagcctgtttggtggtctcttcacacagacgcgcatgaaa

SEQ ID NO: 81 - DNA, 421 bp, Homo sapiens
gtcaggcctttgagcccaagctaagccatcatataccctgtgacctgcacgtatacatccagatggcctgaagcaactgaagatccacaaaagaagtgaaaatagccttaactgatgacattccaccattgtgatttgtttcttccccaccctaactgatcaatgtactttgtaatctcccccacccttaagaagtttctttgtaattctccccacccttgagaatgtattttgtgagatccaccccctgcccccaaaacattgctcttaactccactgcctatcccaaaacctataagtactaatgataatctcaccatcatttgctgactctctttttggactcagcccgcctgcaaggtgaaataaacagccttgttgctcacacaaagcctgtttggtggtctctacacacggacac

SEQ ID NO: 82 - DNA, 974 bp, Homo sapiens
gtggggaagagagagatcagtgtctctttctatacggactgtgtctatatagaaagaagtagacatgagagactccattttgttctgtactaagaaaaattcttctgccttgagatgctgttaatctgtaaccctaccccaaccctgtgctcgcagaaacatgccctgtgtcgactcaaggtttaatggatttagggctatgcaggatgtgctttgttaaacaaatgcttgaaggcagctagcttgttaaaagtcatcaccactccctaatctcaagtacccagggacacaaaacactgcggaaggaaggccgcagggacctctgcctaggaaagccaggtttctccccatgtgatagtctgaaatatggcctcatgggaagggaaaagacctgaccgtcccccagcccgacacccgtaaagggtctgtgctgaggaggattagtaaaagaggaaggcctctttgcagttgagataagaggaaggcgtctgtctcctgctcatccctgagcaatggaatgtctcggtgtaaaacccgattgtatattccatctactgagataggagaaaaccgccttagggctggaggtgagacatgctggcggtaacactgctttttaatgcaccgagatgtttatgtatgtgcacatcaaagcacagcaccttttccttaacattgtttatgacacagagacatttgttcacattttcctgctggccctctccccactattaccctattgtcctgccacatccccctctgggagatggtagagatggtagagataatgatcaataaatactgagggaactcggagactggggccagcgtgggtcctctgtatgctgagcgccagtcccctgggcccatttttctttctctgtactttgtctctgtgtctctttcttttctcagtctctcatcccaccccacgagaaacacccacaggtgtggaggggcaggccaccccttca

SEQ ID NO: 83 - DNA, 295 bp, Homo sapiens
tgggtcaggcacaaagtaagcccaccacactaggaaatatgtggaaaaatttcaagaaaagatttaagggagactatggagtactatgacaccaggaaaacttaaaactttgtgtaaggtagactggccagcattagaggtggccatcagaaggaagcctggacaggtcccttgtttcaaaggtatggcacaaggtaacttgtaagccagggcacccagaccagttcccatacatagacacttggttacagctggttttagaccaccccccacagtggttgagagaacagcagca

SEQ ID NO: 84 - DNA, 823 bp, Homo sapiens
agtgaagaagtgaaatctgggctgcactaaccaatggaaattacttaaaacccttcaccaaacctttcacttaggcattgatagcacccagacgcccaaattattatttactggaccaggccttttcaaaactatcaagcagatagtcagggcctgtgaagtgtgccaaagaaataatcccctgcactgcaggccatacatttcaatccctgtatctttaacctccttgttaagtttgtctcttccagaatcgaagctgtaaaactaaaaatgttcttcaaatggagccccagatgcagtccatgaataagatctaccgtggacccctggaccggcctgctagcccatgctccaatgttaatgacattgaaggcacccctcccgaggaaatctcaactacacaacccctactacacctcaattcagcaggaagaagttagagcggtcgttggccaacctcgccaacagcacttaggttttcctgttgagagggggtactaagagacaggactagctggatttcctagggtgactaagaatccctaagcctagctgggaaggtgaccacatccacctttaaacatggggtttgcaacttagctcacacccgaccaatcaggtagtaaagagagctcactaaaatgctaattaggcaaaaacaggaggcaaagaaatagccaatcatctattgcctgagagcacagtgggaaggataatgactgggatataaacccaggcattcaagccagcaatggctaccctctttgggtcccctccctttgtatgggagctctgttttcactccattaaatcttgcaactgc

SEQ ID NO: 85 - DNA, 5525 bp, Homo sapiens
gtcaggcctctgagctgaagctaagccatcatatcccctgtgacctgcacgtacacatccagatggccggttcctgccttaactgatgacgttccaccacaaaagaagtgaaaatggcctgttcccgccttaactgatgacattgtcttgtgaaattccttctcctggctcatcctggctcaaaagctcccctgctgagcaccttgtgaccttcccgcctccccccaccccgctctgcccgccagagaacaaacccctttgactgtaattttcctttatccacccaaatcctataaaacggccccacccttatctccctttgctgactctcttttcggactcagcccgcctgcacccaggtgaaataaacagccatgttgctcacacacagcctgtttggtggtttcttcacacggccgcgcatgaaatttggtgccgtgactcggatcgggggacctcccttgggagatcaatcccccatcctcctgctctttgctgtgtgagaaagatccacctatgacctcaggtcctcagaccgaccagcccaagaaacatctcaccaatttcaaatccggtaagcggcctctttttactctcttctccaacttccctcactatctctcaacctcttgctcctttcaatcttggtgccacacttcaatctctcccttctctcaatttcaattcctttcatattctggtggagacaaaggagacacgttttatccatggacccaaaactccagcgctggtcacagactgggaaggtagccttcccttggtgtttaatcattgcagggacgcctctctgattattcacccatgtttcaaaggtgtcagaccacgcagggacgcctgccttggtccttcacccttagcggcaagtcccgcttttctgagggaggggcaagtacccctcaaccccttctccttcacccttagcggtaagtcccgcttttctatggggcaagaacccccaatcccttatttccacaccccgacccctttcccgcttttctggagggtaagaacccccgaacctcttccctccgtgtctctactctctcttttctctgggcttgcctccttcactatgggcaagcttccaccttccatttctccttcttctccctaagcctgtgtcctcaagaacttaaaacctcttcaactcacacctgacctaaaacctaaatgccttattttcttctgcaatgccgcttgaccccaatacaaactcgacagtaattccaaatagccagaaaatggcactttgaatttttccatcctgcaagatctaaataattcttgtcgtaaaataggcaaacggtctgaggtgcctgacgtccaggcattcttttacacatcggtcccttcctagtctctgtgcccagtgcaactcatcccaaatcttccttctttccctcccgcctgtcccctcagtcccaaccccaagcatcgctgagtctttctaatcttccttttctacagacccatctgacctctcccctcctcgccaggccgagctaggtcccaattcttcctcagcctccgctcctccaccctataatccttttatcacctcccctcctcacacccggtccagcttacagtttcgttccgtgactggccctcccccacctgcccagcaatttactcttaaaaaggtggctggagctaaaggcatagtcaaggttaatgctcctttttctttatcccaaatcagatagcgtttaggctctttttcatcaaatataaaaacccagcccagttcatggctcgtttggcagcaaccctgagacgctttacagccctagaccctaaaaggtcaaaaggccgtcttatgctcaatatacattttattacccaatctgctcccgatattaaataaaactccaaaaattaaattccggccctcaaactccacaacaggatttaattaacctcgccttcaaggtgtacaataatagaaaaaagttgcaattccttgcctccactgtgagacaaaccccagccacatctccagcacacaagaacttccaaacgcctgaacctcagcggccaggcattcctccggaacctcctcccccaggagcttgctacaagtgcccgaaatctgaccaccaggccgaggaatgcctgcagcccaggattcctcccaagccgtgtcccatctgtgcgggaccccactggaaatcggactgttcaactcacctggcagccactcccagagcccctggaactctggcccaaggctctctgactgactccttctctgcttagcagctaaagactgacattgcccgatagcctcggaagccccgtagaccatcacggatgccgagctttaggtaaccctcacagtggaaggtaagtccgtccccttcttaatcaatacggaggctacccactccacattaccttcttttcaagggcctgtttcccttgcctccataactgttgtgggtattgacagccaggcttctaaaccccttaaaactccccaactctggtgccaacttagacaatactcttttaagcactcctttttagttatccccacctgcccagttcccttattaggccgagatattttaaccaaattatctgcttccctgactattcctggaccacagccgcatctcattgctgcccttcttcccaatccaaagcctcctttgcgtcctcctcttttgtattcccccccaccttaacccacaagtataagatacctctactccctccttggcgaccaatcatgcaccccttaccatctcattaaaacataatcacccttaccccactcaatgccaatatcccatcccacagcatgctttgaaaggagtaaagcctgttatcacatgcctgctacagcatggccttttaaagcctataaactctccttacaattcccccattttacctatcctaaaaccagacaagccttacaagttagttcaggatctatgccttatcaaccaaattgttttgcctatccaccccatggtaccaaaccatatactctcctatcctcaatacctccctccacaatccattattctgttctggatctcaaacatgctttctttacaattcctttgcacccgtcatcccagcctctctttgctttcacttggactgaccctgacatccattaggctcagcaaattacccgggctgtactgctgcaaggcttcacagacagcccccattacttcagtcaagcccaaatttcatcctcatctgttacctgtctcagcataattctcataaaaacacacgtgctctccctgctgatcatgtctgattaatctcccaaacctcaatcccttacaaaacaacaactcctttccttcctaggcatggttagtgaggtcagaattcttacacaagagccaggaccgcaccttgtagcctttctgtccaaacaacttgaccttactgttttagcctagccctcaagtctgcgtgcagcggctgccgctgctttaatacttttagaggccctaaaaataacaaactatgctcaactcactctctacatttctcataacttccaaaattattttcttcctcatacctgatgcatatactttctgctccctggctccttcagctgtactcactctttgttaagtcccacaattaccattgttcctggcccggacctcaatctggcctcccacattattcctgataccacacctgacccccatgactgtatctctctgatccacctgatgttcttcccatttccccacatttccttctttcctgtttctcaccctgatcacgcttgatttattgatggcagttccagcaggcctaatcaccacacagcagcaaaagcaggctatgctatagtacaagccactagcccgcctcttagaacctcatttcctttccattgtggaaatctatcctcaaggaaataacttctcagtgttccatctgctattctgctactcctcaaggattcttcaggccccctcccttccctacacatcaagctcaaggatttgcccccgcccaggactggcaagttagctttactcaacatgcaccgagtcacaaaaactaaaatacctcttagtctaggtagacactttcactggataggtagaggcctttcctacagggtctgagaaggccacacagtcatttcttcccttctgtcagacataattcctcagtttagccttcccacctctatacagtctgataacagaccagcccttattagtcaaatcagccaagcagtttctcaggctcttagtattcagtgaaacctttatatcccttacggtcctccgtcttcaggaaaagtagaacggactaaaggtcttttaaaaacacttcaccaagctcagccaccaacttaaaaaggactggacaatacttttaccactttcccttctcagaagtcagacctgtcctcagaatgctacaaggtacagcccatttgagctcctgtatagacgttcctttttatttggtcccagtctcattccagacaccagaccaacttagactgtgccccaaaaaacttgtcatccctactatcttctgtctagtcatactcctattcaccattctcaactactcatgcattccctgctcttgtttacactgctggtttacactatttctccaagccatcacagctgatatctcctggtgctatccccaaactgccactcttaactcttgaagtaaataaataatctttgctggcaaggctatgctgaatctccttaggtactctaattagatgtcctaggtcctcccaattcttagacctttaatacctgtttttctccttctcttattccgtttagtttttcaattcatacaaaaccgtatccaggccatcaccaataattctaaatgacaaatgtttcttctaatagtcccacagtatcaccccttaccacaaaatcttccttcagcttaatctctcccactctaggttcccacgccgcccctaatcccgctcgaagcagccctgagaaacatcacccattatctctccacaccacccccaaaaattttcaccgtcccaacactttaccactatttcattttatttttcttattaatataagaagacaggaatgtcaggcctctgagccgaagctaagccatcatatcccctgtgacctgcacgtacacatccagatggccggttcctgcctcaactgatgacattccaccacaaaagaagtgaaaatggcctgctcccgccttaactgatgacattgtcttgtgaaattccttctcctggctcattctggctcaaaagctcccctgctgagcaccttgtgacccccactctgcccaccagagaacaaaccccctttgactgtaattttcctttatccacccaaatcctataaaatggccccacccttatctcccttcgctgactctcttttcggactcagcccacctgcacccaggtgaaataaacagccatgttgctcacccaaagcctgtttggtggtctcttcacacggacgtgcatgaaa

SEQ ID NO: 86 - DNA, 1199 bp, Homo sapiens
cccctcccttccctacacatcaagcttggggatttgcccctgcccaggactggcaaattgactttactcatatcaggaaactaaaatgcctcttggtctagttagacactttcactgtatgggtagaggcctttcccacagggtctgaaaaggccaccgcggttatatcttcccttctgtaagacataatacctcagtttggtcttcccacctctatacagtccagtaacagaccggcctttattaatcaaatcacccaagcagtttctcaggctcttggtattcagtggaactttcatgcaccttactgtcctcaatcttcaggaaacgtagaatggactaatggtcttttaaaaacacgcctcatcaagctcagcctccaacttaaaaaggagaactctgacaaggatagagcccaaaaacttacgctgaacccccttggccactctctaagtgtatgtcctgggtcctcccaattcttagtccttaaatacctgtttttctctttctcttattcagatcttgtatcttctgtttagtttctcagttcatacaaaaccacatctaggccatcaccaatcattgtatatgacaaatgcttcttttaacaaccccacaatattgcctcttaccacaaaatcttccttcggcttaatctctcccactctacgttcccacgctgccccaatcccactgacagcagccctgagaaacatcgcccattatctctccataccacctcccaaaattttcgccactccaacacttcaacactattttgttttatttttcttattaatataaaagacaggaatgtcaggcctctgatccgagctaagccatcatatcccctgtgacctgcacgtatacatccagacagcctgaagcaactgaagaatcacaaaagaagtgaaagtggctggttcctgccttaactgatgacattaccttgtgaaattccttctcctggctcagaagctccccactgagcaccttgtgacccctgcccctgctgccagagagcaaccccctttgactgtaattttccactacccacccaaatcctataaaatggccacaccccatctcccttcactgactctctttttggactcagcccgcctgcacccaggtgattaaaaagctttattgccacacaaagcctgtttggtggtctcttcacatggactcgcatgaaa

SEQ ID NO: 87 - DNA, 390 bp, Homo sapiens
gtcaggcctctgagcccaagctaagccatcatattccctgtgaccggcaggtatacatacagatggcctgaagtaactgaagaatcacaaaagaagtgaaaatggcctgttcctgccttaactgatgaccttaccttgtgaaattccttctcctggctcaaaagctcccccactgagcaccttgtgacccccacccctgcctgccagagaacaaccgcctttgactgtaattttccactacctacgcaaatcctataaaacggccccacccctatctcccttcgctgactctcttttcggactcagcccgcctgcacccaggtgaaataaacagccttgttgctcacacaaagcctgtttggtggtcttgtcacacggacgcaagtgaaa

SEQ ID NO: 88 - DNA, 1924 bp, Homo sapiens
accatcctattaaaacctaatcactcttaccctgctcaatgccaatatcttatcctatagcatgctttgaaagaattaaagcctgttatcattcacctgttacagcatggccttttaaagcttataaactcttcttgacattcacctcatttccccatatttccttctttcctcttcctcgccttgatcatgcttgatttattgatggcagttccaccaggcctaattgccacaccagcaaaggcaggctatgctatagtacaagccactatcccacctcttagaacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattagctttactcaacatgtcccgagtcagataactaaaatacctcttagtttaggtagacactttcactggataggtagaggcctttcctacagggtctgagaaggccaccgcagtcatttcttcctttctgtcagacataattcctcagtttagccttcccaccactatacagtctgataacagaccagcctttattagtcaaatcagccaagcagtttttcaggctcttagtattcagtgaaacctttatcccttatggtcctccgtcttcaagaaaagtagaatggactaaatgtcttttaaaaacacacctcaccaagctcagccaacaacttaaaaaggactggacaatacttttaccactttcgcttctcagaagtcagacctgtcctcaggatgctacagtgtacagcccatttgagctcctgtatagatgctcctttttattaggccccagtctcattccagacaccagaccaacttagactgtgcccccaaaaaacttgtcatccctactatcttctatctagtcatactcctattcactgttctcaactactcatacatgccctactcttgtttacactgccagtttgcattatttctccaagccatcacagctgatatctcctggtgctatccccatactgccactctaaactcttgaagtaaataaataatctgctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaataattctacaccacaaatatttcttctaacaactccacaatatcaccttttaccacaaaatcttccttcagcttaatctctcccactctaggttcccacgccacccctaatcctgctcgaagtagccctgagaaacattgcccattatctctccataccacctccaaaaattttcaccatcccaacactttaccactatttcattttatttttcttattaatataagaagacaggaatgtcaggcctctgagcccaagctaagccatcataccccctgtgacctgcatgtacacatccagaaggccagttcctgccttaactgatgacattccaccacaaaagaagtgaaaatggcctgttcctgccttaactgatgacattgtcttgtgaaattccttctcctggctcatcctggctcaaaagctcccctactgagcaccttgtgaccccaactctgcccgccagagaacaacccccctttgactgtaattttcctttatctccccaaatcctataagacagctccacccttatctcccttcgcagagtctcttttcggattcagcccgcctgctctcgggtgattaaaagctttattgctcacacaaagcctgtttggtggtctcttcacatggaggtgcatgaaa

SEQ ID NO: 89 - DNA, 7232 bp, Homo sapiens
gacaggcctctgagcccaagccaagccatcacatcccctgtgacttgcatgtatatgcccagatggcctgaagtaactgaagaatcacaaaagaagtgaaaaggccctgccctgccttaactgatgacattccaccattgtgatttgttcctgccccaccttaactgagtgactaaccctgtgaatttccttctcctggctcagaagctcccccactgagcaccttgtgacccccgcccctgcccaccagaaaacaaccccctttgactgtaattttccattaccttcccaaaccctataaaatggccccacccctatctcccttcgctgactctcttttcggactcagcccacctgcacccaggtgaaataaacagccttgttgctcacacaaagcctgtttggtggtctcttcacacggacgcgcatgaaatttggtgccatgactcggatcgggggacctcccttgggagatcaatcccctgtcctcctgctctttgctccatgaaaaagatccacctatgacctcgagtcctcagacccaccagcctaaggaacatctcaccaattttaaattgggtaagcagcctcttcttactctcttctccaagctctctcactgtccctcaaccactttctcctttccactcttcaatctctcccttctcttaatttcaattcctttcattttctgggagagacaaaggagacatatttaatccatggacccaaaactccggcgctggtcatagactgggaagacagtcttcccttggtgtttaatcattgcagggatgcctctctgattaaacacacaggtttcaagggtgtcagaccacacagggacgcctgccttggtccttcacccttagcggcaagtcccgtttttctggggaaggggcaagtacctcaaccccttctctccttgtctctactccttctctgcttttctgggagaggggcaagtacccctcaaccccctctccttcacccttagcggcaagtcccacttttctatggggcaagaacccccaatcccttatttccatgccccaacctcttatctctgcaccacaatcccttatttctgtgccccaacctcttatctctgtgccccaatccctaatttctgcaccccgacctcttatctctgttccccatcccttatttctgcaccccaacctcgtatctctgtgccccaatcccttacttctgcaccccaacctcttatatctctgcactacaatcccttatttccatgccccaacctcttatctctgcaccccaatcccttatttctgtgccctgaccccttatttccatgccccgaccccttatttccgtgccccaatcccttatttctgcaccccatcctcttatctctgtgccccaatcgcttatttctgtgccccaacctcgtatctctgcaccccaatcccttatttccgcacactgacctcttatctctgtgccccaatcccttatttccatgccccaaccccttctgtgcttttctggagggcaagaaccccccaccccttctctgtgtctctactcttttctctgggcttgcctccttcactatgggtaagcttccaccttccattcctccttcttctcccttagcctgtgttctcaaaaacttaaaacctgttcaactcacacctgacctaaaacctaaatgccttattttcttctgcaatgccgcttgaccccaatacaaactcgacagtagttccaaatagccagaaaacagcaatttcaatttttccatcctacaagatctgaataattcttgtaaaataggcaaatggtctgagatgcctgatgtccaggcattcttttacacatcagtcccttcctagtctctgtgcccagtgcaactcatcccaaatcttccttctttcccccctgcctgtcccctcagtcccaaccccaagcgtcactgagtctttctaatattccttttctacaaacctatctgacctctcccctcctcgccaggctgagctaggtcccaattcttccaccctataatctttttatcacctcccctcctcacaactggtctggcttacagtttcgttccgtgactagccctcccccacctgcccagcaatttactcttaaaaaggtggctggagccaaaggcatagtcagggttaatgctcctttttctttatcccaaatcagaagcgtttaggctctttttcatcaaatataaaaatccagcccagttcatggctcatttggcagcaaccctgagacactttacaaccctaaaatgtcaaaaggccgtcttattctcaatatacattttattaaccaatctgctcccgaaattaaataaaactccaaaaattggaatctggccctcaaaccccacaacaagacttaattaacctcaccttcaaggtgtgcaataacagaaaatagttgcaattccttgcctccactgtgagacaaaccccagccacatctccagcacacaagaacttccaaacgcctgaactgcagcagccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcagctcacctggcagccactcccagagcccctggaactctggcccaaggctctctgactgactccttttgggcttagcggctgaagactgacgctgcctgatcacctcggaagccccatagaccatcacagacgccgagctttggataactctcacagtggaaggtaagtccgtccccttcttaatcaatacggaggctacccactccacattaccttcttttcaaggacctgtttcccttgcctccataactgttgtgggtattgacagccaggcttctaaacctcttaaaactccccaactctggtgccaacttagacaatactcttttatgcacccttttttagttatccccacctgcccagttcccttattaggccgagatattttaaccaaattatctgcttccctgactattcctggactatagccgcatctcattgctgcccttcttcccaatccaaagcctcctttgcgtccttctcttgtattcccccaccttaacccacaagtataagatacctctactccctccttggtgaccaatcatgcgccccttaccatctcattaaaacctaatcacccttaccccactcaatgccaatatcccatcccagagcacgctttaaaaggattaaagcctgttatcactcacctgctacagcatgggcttctaaaacctataaactctccttaccattcccccattttacctgtcctaaaaccagacaagccttacaagttagttcagaatctgtgccttatcaaccaaattgttttgcctatccaacccatggtgccaaacccatatactctcctatcctcaatacctccctctactacccattattctgttctggatctcaaacatgctttctttactattcctttgcacccttcaccccagcctctctttgccttcacttagtttgaccctgacacccattaggctcagcaaattacctgggctgcactgccgcaaggcttcacagacagcccccattacttcagccaagcccaaatttcatcctcatctgttacctatcttggcataattctcataaaaacacacgtgctctccctgctgatcatgtccgattaatctcccaaacctcaatcccttacaaaacaacaactcctttccttcctaggcatggttagtgtggtcagaattcttacacaagagccaggaccacaccgtgtagcctttctgtccaaacaacttgaccttactgttttagcctagccctcatgtctgtgtgcagcagctgctgctgctttaatactgttagaggccctaaaaatcacaaactatgctcaactcactctctacatttctcataacttccaaaatctattttcttcctcatacctgacacatatactttctgctccctggctccttcagctgtactcactatttaagtcccacaattaccattgttcctggcccggacttcaatctggcctctcacattattcctgataccacacctgacccccatgactgtatctctctgatccacctgatattcaccccatttccccatatttccttctttcctgttcctcaccctgatcatgcttgatttattgatggcagttccaccaggcctaatcgccacacaccagcaaaggcaggctatgctatagtacaagccactagcccacctctcagaacctctcatttcctttccatcatggaaatctatcctcgaggaaataacttctcagtgttccatctgctattctactactacacagggattattcaggccccctcccttccctacacataaagctcgaggatttgcccccacccaggactggcaaattagctttactcaacatgtcccgagtcaggaaactaaaatacctcttagtctaaatagacactttcactgaataagtaaagacctttcctacagggtctaagaaggccaccacagtcatttcttccctactgtcagacataattcctcagtttagccttcccacctctatacagtctgataacagaccagcctttattagtcaaatcagccaagcagtttttcaggctcttagtattcagtgaaacctttatatcccttacggtactccatcttcaagaaaagtagaacggactaaaggtcttttaaaaacacacctcaccaagctcagccaccaacttaaaaaggactggacaatacttttatcactttcgcttctcagaattcaggcctgtcctcagaatgctacaaggtacagcccatttgagctcctgtatagacgctccttttttttttttatttaagttttagggtacatttgcacattgtgcaggttagttacatatgtatacatgtgccatgctggtgcgctgcacccactaacttgtcatctagcattaggtatatctcccgatgctatccctcccccctccccccaccccacaacagtccccagagtgtgatgttccccttcctgtgtccatgtgatctcattgttcaattcccacctatgagtgagaatatgtggtgtttcgttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcatgtgtgtgaataaacatacgtgtgcatgtgtctttatagcagcatgatttatagtcctttgggtatataaccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggatttgatttgcatttctctgatggccagtgatgatgagcattttttcatgtgtcttttggctgaataaatgtcttcttttgagaagtgtctgttcatgtccttcgcccactttttgatggggttgtttgtttttttcttgtaaatttgtttgagttctttatagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctggctagccatatgtagaaagctgaaactggatcccttccttacaccttatacaaaaatcaattcaagatggattaaagacttaaacgttagacctaaaaccataaaaaccctagaagacactcctttttattaggccccagtctcattcaacaccagaccaacttagactgtccctcaaaaaaacttgtcatccctactatcttttgtctagtcatactcctattcaccattctcaactactcatacatgccctgctcttatttacactgctggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccagtttttcaattcatacaaaactgtatccaggccatcaccagtcattctatacgacaaatgtttcttctgataaccccacaatatcaccccttaccacaagatcttcctttagcttaatctctcccactctaggtttccacaccgcccctaatcctgcttgaagcagccctgagaaacatcgtccattctctctccataccacccccaaaaattttcgccgccccaacacttcaacactattttgttttctttttcttattaatataagaaggcaggaatgtcaggcctctgagcccaagccaaaccatcgcatcccctgtgacttgcacgtatacgtccagatggcctgaagtaactgaagaatcacaaaagaagtgaaaaggccccgtcccgccttaactgatgacattccaccattgtgatttgttcctgccccaccttaactgagtgactaaacctgtgaatttccttctcctggctcagaagctcccccactgagcaccttgtgacccccacccctgcccatcagaaaacaaccccctttgactgtaattttccattaccttcccaaatcctataaaacggccccagcccatctcccttcactgactctctttttggactcagcctgcctgcacccaggtgaataaacagccttgtggctcacacaaagcctgtttggtggtctcttcacatggacgcgcatgaaa

SEQ ID NO: 90 - DNA, 12115 bp, Homo sapiens
gtcaggcctctgagcccaagccaagccatcgcatcccctatgacttacacgtgtacatccagatggcctgaagtaactaaagatccacaaaagaagtaaaaatagccttaactgatgacattccaccattgtgatttgtttctgccccacccgaactgatcaatgtactttgtaatctcccccacccttaagaaggttctttgaaattctccccactcttgaggatgtactttgtgagatccacccctgcccgcaaaacattgctcttaacttcaccgcctatcccaaaacccataagaactaatgataatccaccaccctttgccgactctcttttcggactcagcccgcctgcacccaggtgaaataaacagccatgttgctcacacaaagcctgtttggtggtctcttcacatggacgcgcatgaaatttggtgccgtgactcagatcgggagacctcccttgggagatcaatcccctatcctcctgctctttgctccatgagaaagatccacctacgacctcaggtcctcagacccaccagcccaagaaacatctcaccaatttcaaatccaataagcagcctctttttactctcttctccaacctccctatccctcaccgtctttctcctttcaatctaggcgccacacttcaatctctcccttctcttaatttcaattcctttcattttctggtagagacaaaggagacgttttatctgtggacccaaaaaaccggcgccggtcacggactgggaaggcagccttcccttggtgtttaatcattgcaaggacgcctctgatcattcacccacgtttcagaggtgtcagaccacgcagggacacctgccttggtccataacccttagcggcaagtcccgcttttctgaggaaggggcaaggaccccaaccccttctttccgtgtctctaccccttctctgattttctggggcaggggcaagaaccccccaaccccttctccttcacccttagcggcaagtcccgcttttctgggggagaggcaagtaccccaaactcgtatctctgtgccccaatcccttatttccatgccccaacccctttcccgcttttctggagggtaagaacccccaaaccccttccctccatgtctctacgctctcttttctctgggcttgcctccttcactatgggcaaccttcctacattcctccttcttctcccttagcctgtgttctcaagaacttaaaacctcttcaactcatacctgacctaaaacctaaataaatgccttattttcttctgcaatgccgcttgaccccaatacaaactcgacagtagttccaaatagccagaaaacggcactttcaatttttccatcctgcaagatctaaataattcttgtcgtaaaatgggcaaacagtctgaggtgcctgatgtccaggcattcttttacacatcagtcccttcctagtctctgtgcccagtgcaactcgtcccaaatcttccttctttccctcccgcctgtcccctcagtcccaaccccaagcgttgctgagtctttctaatcttccttttctacagacccatctgacctctcccctcctcgccaggccgagctaggttccaattcttcctcagcccctagaccctaaaaggtcaaaaggccgtcttattctcaatatacattttattacccaatctgctcccgacattaaataaaactccaaaaattagaatctggccctcaaactccacaacaggacttaattaacctcaccttcaaggtgtacaataatagaaaaaagttgcaattccttgcctccactgtgagacaaaccccagccacatctccagcacacaagaacttccaaatgcctgaaccgcagcggccaggcgttcctccagaacctcctcccccaggagcttgctacacgtgccagaaatctgactaccagggccaaggaatgcctgcagcccaggattcctcctaagccgtgtcccatctgtgcgggaccccactggaaatcggactgttcaactcacctggcagccactcccagagcccctagaactctggcccaaggctctctgactgactccttggcttagcggctgaagattgacgctgcccaatcgccttggaagcccccagaccatcacggacgccaagctttgggtaactctcacagtggagggtaagtccacccactgtttaatcgaaacggggactacccactccatgttgccttcttttcaagggcctgtttcccttgcctccataactgttgtgggtatggacggccaggcttctaaacctcttaaaactccccaactctggtgccaacttagacattactctttgaagcactcatttttagttatccccacctgcccagttcccttattaggccgagatattttaagcaaattatctgcttccctgactattcctggactacagccgcatctcattgccgcccttctccccaacccaaagcctcctttgcgtcttcctctcatatccccccaccttaacccacaaatatgggacatttctactccttccctgacaactgatcacatgcccattaccatcccattaaaacctaatcacccttaccccgctcaacgccaatatcccatcccacagcacgctttaaaaggattaaagcctgttatcactggcctgctacagcataggcttctaaaacctataaactcttcttataatccccccattttacctgtccagaaaccggacaagtcttacagattagttcaggatctgcgccttatcaaccaaattgttttgcctatccaccctgtggtgcccaacccatacactctttcatcctcaataccttcctccacaactcactattccacacttgatcttaaagatgcttctttcagcgttcccctgcaccccttgtcccagcctctctttgctttcacctggactgaccctgacacccatcagtcccagcagcttacctgggctgtgctgccacaaggtttcagggacagccctcattacttcagccaagctctttctcatgatctactttctttccacccctccgcttctcaccttatttaatatattgatgaccttcttctttgtagcccctcctttgaatcttctcaacaagacacacttctgctccttcagcatttactctccaaaggatatcaggtatccccctccaaagctcaaatttcatcctcatctgttacctatctcggcataattctcataaaaacacacgtgctctgcctgttgatcttgtctgattaatctcccaaacctcaatcccttccaaaacaacaactcccttccttcctaggcatggttagtgcggtcagaattcttacacaacagccaggaccacaccctgtagcctttctgtccaaacaacttgaccttactgttttagcctagccctcatgtctgcgtgcagcggctgccgctgctttaatacttttagaggccgtaaaaatcacaaactatgctcaactcactctctacatttctcataacttccaaaatccattttcttcctcatacctgatgcatatactttctgctccccggctccttcagctgtactcactctttgttaagtcccacaattaccattgttcctggcccggacctcaatctggcctcccacattattcctgataccacacctgacccccatgactgtgtttctctgatccacctgacattcaccccatttccccatatttccttctttcctgttcctcaccctgatcacgcttgatttattgatggcggttccaccaggcctaatcgccacatagcagcaaaggcaggctatgctatagtacaagccactagcccgcctcttagaacctctcatttcctttccatcgtggaaatctatcctcaaggaaataacttctcagtgttccatctgctattctactactcctcagggattattcaggccccttcccttccctacacatcaagcttgaagatttgcccccacccaggactggcaaattagcttcactcaacatgccccgagtcagataactaaaatacctcttagtctaagtagacactttcactagataagtagaggcctttcctacagggtctgagaaggccaccgcagtcatttcttcccttctgtcagacataattcctcagtttagccttcccacctctatacagtctgataacggaccagcctttactagtcaaatcacccaagcagtttctcaggctcttagtattcagtggaaccttcatatcccttacagtcctcaatcttcaggaaaggtagaacggactaatggtcttttaaaggtacacatcaccaagctcagcctccaacttaaaaaggattggacagtacttttacttcttgctcttctcagaattagagcctgttctcgagatgctacagggtaggtacagtccatttgaacttttatatggacgcactttcttgcttggccccaacctcatcccagacaccagccctctaggcgactgtcttccagtcctccagcaggctagacaggaaattcgccaggctgctaagcttctcttgcctactccagatccccagccatatgaagacaccctagctggacgatcagttcttgttaatctgactcctcaaactctacaacctcgatggaccggaccctacttagtcatctatagtaccccgactgctgtccgcctgcaggatcctccccactaggctcaccgttccagaataaagctgtgtccatcggacagccagcctaatccctcctcttcctcctggaagttgcaagtactctcccctacttcccttaaactcagtcgtatttcgaagaacagtcataacccttatgagcctaatacatcccttcattctattaggtttttcgtccttaccctactttttgcaacagggctttacgaagtcacccccaccacttaggccgagccccaaaaaactagtcatccctactatcttctgtctggtcatactcctattctccattctcaactacttataaatgccctactcttgtttacacggccggtttacactgtttcttcaagccatcacagctgatatctcttggtgctatccccaaactgccactcttaactccctcttagagtggatagatgatctttgctggcaaggcaccctccaatatttccaccctgatgaagttctattctttacttttatactcactcttattctcattcccattcttatgccaccctctacctctccccagctatctccaccacactatcaaccttacccattctctcctagccgcttctaatccctccttagtgaacaactgctggctttgcatttccctttcttccagtgcctacacagctgtccccaccttacagacagactgggcaacatctcccatctccctacacctccgaacttcctgtaacagccctcacctttaccctcctgaagaactcatttactttctagacaggtccagcaagacttccccagacatttcacatcagcaagctgccgccctccttcacacttatttaaaaaacctttctcctttctcctttctccccccatattcggacctctcacaacacaaactactatgcctgtggccgctcctatatgtatctctcggcaaagacccactggaattcccctaggtaatctttcaccttctcgatgttcctttactcttcatctccaaagtccaactacacacatcactcaaacaatgggagccttccagctccatattacagacaagcccgctatcaatactgacaaacttaaaaacattagcagtaattattgcttaggaagacacttgccctgtatttcactccatccttggctactttccccttgctcatcagactcttcctcccaggccctcctcttgtttacttttacccagccccgaaaataatagtgaaaggttgcttgtagatactcaacgttttctcatacaccatgaaaatcgaacctccccctctatgcagttaccccatcagtccccattacaacctctgacagctgccgccctagctggatccctaggactctaggtacaagacaccccttgcagcactcctcatctttttactttacatctccagttttgcctcgcacaaggtctcttcttcctctgtggatcctttacctaacatgtgtctacctgctaattggacaggcacatgcacactagtcttccttactcccaaaattcaatttgcaaataggaacgaagagctccctgttcccctcatgacaccgacacaacaaagaagagtcattccactaattcccttgatggtcggtttaggactttctgcctccactattgctctcggtactggaatagcaggcatttcaacctctgtcatgaccttccgtagcctgtctaatgacttctctgctagcatcacagacatgtcacaaactttatcagtcctccaggcccaagttgactctttagctgcagttgtcctccaaaaccaccgaggccttgcttactcactgttgaaaaaagaggactctgcatattcttaaatgaagagtgttgtttttacctaaatcaatctggcctgatgtatgacaacataaaaaaactcaagcatagagcccaaaaacttgccaaccaagcaagtaattacgctgaacccccttacgcactctctaattggatgtcctaggtcctcccaattcttagtcctttaatacccatttttctccttcttttatttggaccttggatcttctgtttagtttctcaattcatccaaaactgtatccagaccatcaccaatcattctatacaacaaatgtttcttctaacatccccacaatatcaccccttaccacaagacctcccttcagcttaatctctcccactctaggttcccacgccgcccctaatcccgcttgaagcagccctgagaaacatcgcccattctgtctccataccaccccccaaaaattttcaccgccccaatacttcaacactattttatttttcttattaacataagaaggcaggaatgtcaggcctctgagcccaagccaagccatcgcatcccctatgacttgcacgtatacatccagatggcctgaagtaaatgaagatccacaaaagaagtaaaaatagccttagctgatgacattccaccattgtgatttgtttctgccccacccgaactgatcaatgtactttgtaatctcccccacccttaagaaggttctttgtaattctccccactcttgagaatgtactttgtgagatccactcctgcccacaaaacattgctcttaacttcaccgcctatcccaaaacccataagaactaatgataatccaccaccctttgctgactctcttttcggactcagcccgcctgcacccaggtgaaataaacagccatgttgctcacacaaagcctgtttggtggtctcttcacacggacgcgcatgaaacacttcaatctctcccttaatttcaattcctttcattttctggtagagacaaaggagacacattttatctgtggactcaaaactccggcgccggtcagagactgggaaggcagccttcccttggtgtttaatcactgcagggacgcctgattatttacccacgtttcaaaggtgtcagaccatgcagggacgcctgccttggtccttcacccttagcggcaagtcccacttttctggcggagaggcaagtacaccaaccccttctctccgtgtctctaccccttctctgcttttctaggggaggggtaagtaccccaaccccatgtatctctgcgccccgatcccttatttctgcgccccaatctcttatatctctgtgccccaatcccttatttccgtgccccaaccccttctctgcttttctggagggcaagaaccccccaccccttctccgtgtctctactcttttctctgggcttacctccttcactatgggcaagcttccaccttccattcctttcttctcccttagcctgtgttcttaagaacttaaaacctcttcaactcacacctgacctaaaacctaaataaatgccttattttcttctgcaattccacttgaccccaatacaaactcgacagtagttccaaatagccagaaaacggcactttcagtttttccatcctacaagatctaaataattcttgtcgtaaaatgggcaaacggtctgaggtgcctgatgtccaggcattcttttacacatcagtcccttcctagtctctgtgcccagtgcaactcgtcccaaatcttccttctttccctcccacctgtcccctcagtcgcaaccccaagcgtcgctgagtctttctaatattccttttctacagacccatctgacctctcctcctcgccaggctgagctaggttccaattcttcctcagcctccgctcctccaccctataatccttttatcacctcccctcctcacacctggaccagcttacagttcattctgtgactggccctcccccacctgcccagcaatttactcttgaaaaggtggctggagctaaaggcatagtcaaagttaatgctcctttttctttatcccaaatcagatagcgtttaggttctttttcatcaaatataaaaatccagcccagttcatggctcgtttggcagcaaccctgacacgctttacagccctagaccctaaaaggtcaaaaggccgtcttattctcaatatacattttattacccaatctgctcccgacattaaataaaactccaaaaattagaatctggccctcaaaccccataacaggacttaactaacctcaccttcaaggtggacagtaatagaaaaaagtggcaattccttgcctccactgtgagacaaaccccagccacatctccagcacacaagaacttccaaacgcctgaaccgcagcagccaggcgttcctccagaacctcctcccccaggagcttgctacacgtgctggaaatctggccactgggccaaggaatgcccacagcccgggattcctcctaagccgcgtcccatctgtgcgggaccccatgaaaatcagactgttcaactcacctggcagccactccccagagcccctggaactctggcccaaggctctctgactccttcccagatctcggcttagcagctgaagactgacactgcccaatcccctcggaagccccataaaccatcacggacgccgagcatcgggtaactctcacagtggagggtaagtccatccccttcttaatcaatacggaggctacccactccacattaccttcttttcaagggcctgtttcccttgcctccgtaactgttgtgggtattgacggccaggcttctaaacctcttaaaactccccaactctggtgccaatttagacattactcttttaagcactccttttcagttatccccacctgcccagttcccttattaggccgagacactttaaattatctgcttccctgagtattcctgaactacagctacatctcattgccgcccttcttcccaatccaaagcctcctttgtgtcctcctcttgtatcccccaaccttaacccacaagtataagatacctctactccctccttggcaaccaatcatgcaccccttaccatctcattaaaacctaatcacccttaccccactcaatgtcccatcccatggcacgctttaaaaggattaaagcctgttatcactcgcctgctacagcatggccttttaaaacctataaactctccttacaattcccccattttacctgtcctaaaaccagacaaggcttacaggttacttcagaatctgcgcgttatcaaccaaattgttttgcctatccaccccgtggtgccaaacccatatactctcctgtcctcaatacctccatctactacccattattctgttctggatctcaaacatgctttctttactattcctttgcacccttcatcccagcgtctctttgctttcagttagatgaccctgacacccatcaggctcagcaaattacctgggctgtacggccacaaggcttcacagacagcccccactacttcagtcaagcccaaatttcatccccatctgttacctatctcggcataattctcataaaaacacacgtgctctccctgttgatcgtgtctgattaatctcccaaacctcaatcccttacaaaacaacaactcccttccttcctaggcatggttagtgcggtcagaattcttacacaacagccaggaccacaccctgtagcctttctgtccaaacaacttgaccttactgttttagcctagccctcatgtctgcgtgcagcggctgccgctgctttaatacttttagaggccgtaaaaatcacaaactatgctcaactcactctctacatttctcgtaacttccaaaatctactttcttcctcatacctgatgcatatactttctgctccccggctccttcagctgtactcactctttgttaagtcccacaattaccattgttcctggcccggacctcaatctggcctcccacattattcctgataccacacctgacccccatgactgtatctctctgatccacctgatattcaccccatttccccatatttccttctttcctgttcctcaccctgatcacgcttgatttattgatggcggttccaccaggcctaatcgccacatagcagcaaaggcaggctatgctatagtacaagccactagcccgcctcttagaacgtctcatttcctttccatcgtggaaatctatcctcaaggaaataacttctcagtgttccatctgctattctactactcctcagggattattcaggccccctcccttccctacacatcaagcttgaagatttgcccccacccaggactggcaaattagcttcactcaacatgccccgagtcaggtaactaaaatacctcttactctaagtagacactttcactagataagtagaggcctttcctacagggtctgagaaggccaccgcagtcatttcttcccttctgtcagacataattcctcagtttagccttcccacctctatacagtctgataacggaccagcctttactagtcaaatcacccaagcagtttctcaggctcttagtattcagtggaaccttcatatcccttacagtcctcaatcttcaggaaaggtagaatggactaaaggtcttttaaaaacacacctcaccaagctcagcctccaacttaaaaaggactggacaatacttttaccactttcccttctcagaattcaggcctgtcctcagaatgctacaaggtacagcccatgtaagctcctgtatagacgctcctttttattaggccccagtctcattccagacaccagaccaacttagactgtgccccccaaaacttgtcatccctactatctcctgtctagtcatattcctattcgccattctcaactactcatacatgccctgctcttgtttacactgccggtttacactgtttctccaagccatcacagctgatatctcctggtgctatccccaaactgccactctaaactcttgaggtaaataaataatctttgctggcaggactatgctgaatctccttaggcactctctaatcagatgtcataggtcctcccaattcttagaccttttatacctgtttttctccttctcttattccatttagtttctgaattcatccaaaaccgtatccaggccatcaccaatcattctatacgacagatgtttcttctaacatccccacaatatcaccccttaccacaagacctcccttcagcttaatctctcccactctaggttcccacgccgcccctaatcccgcttgaagcagccctgagaaacatcgtccattctctctccataccaccccctaaaaattttcaccgccccaacacttcaacactattttatttttcttattaatataagaaggcaggaatgtcaggcctctgagcccaagccaagccatcgcatcccctgtgacttgcacgtatacatccagatggcctgaagtaactgaagatccgcaaaagtaaaaatagccttaactgatgacatcccaccat

SEQ ID NO: 91 - DNA, 395 bp, Homo sapiens
gttaggcctctgagtgcaagctaagccatcataacccctgtgacttgcacgtgtacatccagatggcctgaagtaactgaagaatctcaaaagaagtgaaaatggcctgttcctgccttaaccgatgacatcaccttgtgaaattccttcttctgactcatcctggctcaaaagctccctcactgagcaccttgtgaccccagcccctgccagccagagaacaacctcctttgactgtaattttccactacctacccaaatcctataaaatgtccccaccccatctcccttgctgactctcttttctgactcagctcacctgcacccagtcgaaataaacagccttgttcacacaaagcctgtgaggtggtctcttcacacggacgtacatgaaa

SEQ ID NO: 92 - DNA, 497 bp, Homo sapiens
atggaatgagaccaccacttctcctgttgtccttcccagcttctcccctacctcctcttttccctagtttataagacaggagaaaagggagaaagcaaaaagttggaaagaaacagaagtaagataaatagctagatgaccttggcgccaccatctggccctggtggttaaaataataataataatattaacccctgatcaaaattacttgtgttatctgtaaattccagacattgtatgagaaagcactgtaaaactttttgttctgttaggtgatgcatgtagcccccagtcacgttcctcatgcttgcttgatctattatgaccctttcacgtggatcccttagagttgtaagcccttaaaagggctaggaatttctttttcggagagctcagctcttaagatgagactctgccaactcttccagccgaataaaaacctcttccttctttaatctggtgtctgaggagttttgtctggggcttgtccggctaca

SEQ ID NO: 93 - DNA, 1701 bp, Homo sapiens
cctccatcattaatgcctctttaataaaaactctgctcaaggccgttttacttccaaaggaagctggagtcattcactgcaagggccatcaaaaggcatcagattccatcgctcagggcaacacttatgctgataaggtagctaaaaaagcaactaggttccaacttctatcccttatggcagtttttctccttctcagctggtcactcccacctactcccccacagaaacttccacctatcaatctcttcccacacaaggcaaatggttcttggaccaaggaaaatatctccttccagcctcacaggcccattctattctgttgtcatttcataacctcttccatgtaggttacaagctgctagcccacctcttagaacctctcatttcctttccatcgtggaaatctatcctcaaggaaatcacttctcagtgttccatatgctattctactactcctcagggattgttcaggccccctcccttccctacacatcaagctcggggatttgcccctgcccaggactggcaaattgactttactcacatgccccaagtcaggaaactaaaatacctcttggtctagtagacattttcactggatggtagaggcctttcccaaagggtctgaaaaggctaccatggtcatttctccccttctgtaagacataattccttggtttggccttcccacctctatacagtctgataacggactggcctttattagtcaaatcacccaagcagtttttcaggctcttggtattcagtggaaacttcataccccttaccgtcctcaatcttcagaaaaggtagaatggactaatggtctttaaaaacacacctcaccaagttcagcctccaacttaaaaaggaggactctgtcaaggataagcccaaaaactcaccaaccaagcaagtaattacgctgaaccctcctgggcactctctaattggatgtcctgggttctcctaattcttagccctttaatacctgtttttctccttctcttattcagaccttgtgtcttccgtttagtttctcaattcatacaaaactgcatccaggccatcaccaatcattctatatgacaaatgcttcttttaacaaccccacaatatcgccccttaccacaaaagcttccttcagcttaatctctcccactctaggttcccacgccgcccctaatcccgctcgaagcagccctgagaaacatctcccattatctctccataccactccccaaaattttcgctgccccaacacttcaacactatgttgttttatttttcttattaatataagaagacaggaatgtcaggcctctgagcccaagctaagccatcatatcccctgtgacctgcatgtatacatccagatggcctgaaacaagtgaagaatcacaaaagaagtgaaaatggctggttcctgccttaactgatgacattaccttgtgaaattccttctcctggctcagaagctcccccactgagcaccttgtgacccctgccggtgccagccagagaataaccccctttgactgtaattttccactacctacccaaatcctataaaactgccccaccccatctccctttgctgactcttttcagactcagcctgcctgcacccaggtgattaaaaagttttattgctgacacaaagcctgtttggtggtctcttcacacggactcgcatga

SEQ ID NO: 94 - DNA, 390 bp, Homo sapiens
gtccggcctctgagcccaagctaagccatcatatcccctatgacctgcacgtatacatccagatgccctgaagcaactgaagaatcacaaaagacgtgaaaatggctggtttctgccttaactgatgacattaccttgtgaaattccttctcctggctcagaagctcccctactgagcaccttgcaacccccgcccctgcccgccagagaacaaccccctttgactgtaattttccactacctacccaaatcctataaaagggccccacccctatctcccttcgctgactctcttttcggactcagcccacctgcacccaggtgaaataaacagccttgttgctcacacaaagcctgtttggtggtctcttcacacagacgcgaacaaaa

SEQ ID NO: 95 - DNA, 5517 bp, Homo sapiens
gtcaggcctctgagcccaggctaagccatcatgtcccctgtgacctgcatgtacacatccagacggctggttcctgccttaactgctgacattccaccacaaaagaagtgaaaatgtcctgttcctgcctcaactgatgacattgtcttgtgaaattccttctcctggctcatcctggctcaaaagctcccccactgagtaacttgtaacccccactctgcccgccagagaacaaccccccctttgactggattgggtaggatttacctacccaaatcctataaaacggccccacccctatctcccttccctgactctctttttggacccagcacacctgcacccaggggaaataaacagctttattgctcacagaaagcctgtttggtggtctcttcacacagacacgagtgaaatttggtgctgtgacttggatcgggggacctcccttgggacatcaatcccctgtcctcctgttctttgctccgtgagaaagatccacctacaacctcaggtcctcagactgaccagcccaagaaacgtctcaccaatttcaagtatggtaagtggcctctttttactctctcctccaacctcacttactatccctcaacctctttctcctttcaatcttggcaccacacttcaatctctcccttcttttaatttcaattcctttcattttctggtagagacaaaggagacgcgttttatccgtggacccaaaactccagtgctggtcacggactgggaaggcagccttcccttggtgtttaatcatttcagggacgcctctctgattattcacccatgtttcagaggtgtcagaccacgcagggacgcctgtcttggtccttcacccttagaggcaagtcccgcttttctaggggaggggaaagtaccccaacctcatatctctgtgccctgatcccttatttccacaccccaacctcttatatctctgtgccccgatcccttatttccgtgcccctacctctcccgcttttctggagggtaagaacccccaaaccccttccctccgtttctctactctctcttttctctgggcttgcctccttcactgtgggcaaccttccaccctccattgctccttctcccttagcctgtgttcttaagaacttaaaacctcttcagctctcacctgacctaaactctcagcatcttattttcttccgcaatgccacctgaccgcaatacaaactcgacagtagttccaaatagccagaaaacggcactttcaatttttccatcctgcaagatctaaataattcttgttgtaagatgggtaaatggtctgaggtgcctgacgtccaggcattcttttacacgtcggtccctctctagtctctgttcccaatgcaactcatcccaaatcttccttctttccctcccacccgtcccctcagtcccaaccccaagggtcgctgagtctttctaatcttccatttctacagacccatctgacctctcccctcctccccaggctgctcctcgccaggccgagctacgtcccaattcttcctcagcctctgctcctccaccctataatccttttatcacctcccctcctcacacctggtccggcttacagtttcgttccgtgaccagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctcccgacattaaataaaactccaaaaattaaattccggcccttaaacccctcaacaggatttaattaacctcaccttcaaggtgtacaataatagaaaaaagttgcaattccttgcctccactgtgagacaaaccccagccacatctccagcacacaagaacttccaaacgcctgaaccacagcggccaggccttcctccagaacatcctcccccaggagcttgctacaagtgccagaaatctggccaccaggccaaggaatgcctgcagcccgggattcctcctaagccacgtcccatctgtgcgggaccccactggaaatcggactgtccaactcacctggcagccactcccagagcccctggaactctggcccaaggctctctgacggcttcccagatcttcttggcttagcggctgaagactgactctgcccgatcacctcggaagccccctaggccatcacggacgccgagcttcgggtaactctcacggtggaagctaagcccgtccccttcttaatcaatacggagcctacccactccacattaccttcttttcaagggcctgtttcccttgcctccataactgttgtgggtattgacggccaggcttctaaacctcttaaaactccccaactctggttccaacttagacaatactcttctaagcactccttttagttatccccacctgcccagttcccttattaggccgagacactttaactaaattatctgcttccctgactattcctgtattacagctacatctcattgctgcccttcttcccaatccaaagcctcctttgcgtcctcctcttgtattctcccaccttaacccacaagaataagatacctctactccctccttggcgaccgatcatgcaccccttactatctcattaaaacctaatcacccttaccccgctcaatgccaatatcccatcccacaccatgctttgaaaggattaaagcctgttatcactcacctgctacagcatggccttttaaagcctataaactctccttacaattcccccattatacctgtcctaaaaccagacaagccttccaagttagttcaggatctatgccttatcaaccaaattgttttgcctatccaccccatggtgccaaacccatatactctcctatcctcaatacctccctccacaatccattattctgtgctggatctcaaacctgctttctttactattcctttgcacccatcatcccagcctctcttcgctttcacctggactgaccctgacacccatcaggctcaggaaattacctgggctgtactgccgcaaagtttcacagacagcccccattacttcagtcaagcccaaatttattccttatctgttacctatctcagcataattctcataaaaacacacgtgctctccctgctgatgtccaattaatctcccaaacctcaatcccttacaaaacaacaactcctttccttcctaggcatggtttgtgcggtcagaattcttacacaagagccaggaccgcaccctgtagcctttctgtccaaacaacttgaccttactgttttagcctagccctcatgtctgcgtgcgtggctgctgccaccctaatacttttagaggccctaaaaatcacaaactatgctcaacttactctctacatttctcataacttccaaaatctattttcttcctcatacctgacgcatatactttcggcttcctggctccttcagctatactcactctttgttaactcccacaattaccattgttcctggcccggacttcaatctggcctcccacattattcctgataccacacctgacctccatgactgtatctctctgatccacctgacattcaccacatttccccatatttccttctttcctgttcctcaccctgatcacgcttgatttattgatggcagttccaccaggcctaatcgccacacaccagcaaaggcaggctatgctatagtacaagccactagcccccctcttagaacctctcattttctttccatcgtggaaatctgtcctcaaggaaataacttctcagtgttccatctgctattctactactcctcagggattattcaggccccctcccttccttacacatcaagctcgaggatttgcccctacccaggactggcaaattagctttactcaacatgccccgagtcagataactaaaatacctcttagtctaggtagacactttcactggataggtacaggcctttcctacagggtctgagaaggccaccgcagtcatttcttcccttctgtcagacacaattcctcagtttagccttcccacctcaatacagtctgataacagacgagcctttattagtcaaatcagccaagcagtttttcaggctcttagtattcagtgaaacctttatatcccttatggtcctccgtcttcaggaaaagtagaatggactaaaggtcttttaaaaacacacctcaccaagctcagtcaccaacttaaaaaggactggacaatacttttaccactttcacttctcagaactcaggcctgtcctcggaatgctacagggtacagcccatttgagctcctttttttattaggccccagtctcattccagacaccagaccaacttggactgtgccccaaaaaacttgtcatccctactatcttctgtctagtcatactcctattcaccgttctcaactactcatacatgccctgctcttgtttacactgccagtttacactgtttctccaagccagcacagctgatatctcctggtgctatccccaaaccgccactcttaactcttaaagtaaataaataatctttactggcaaggctatgctgaaccaccttaggcactctctaattagatgtcgtaggtcctcccaattctgagtcctttaatacctgtttttctccttctcttattctgtttagtttttcaattcatacaaaactgtatccaggccaacaccaataattctaaataacaaatgtttcttctaacagccccacaatatcaccccttgccacaaaattttccttcagcttaatctctcccactctaggttcccacgccgcccctaatcccgctcgaagcagccctgagaaacatcacccattatctctccataccaccaaaaaattttcactgtcccaacactttaccactatttcattttattgttcttattaatataagaagacaggaatgtcaggcctctgagcccaagctaagccatcacataccctgtgacctgcaggtacacatccagatggctggttcctgccttaactgctgacattccaccacaaaagaagtgaaaatgtcctgttcctgccttaactgatgacattgtcttgtgaaattccttctcctggctcatcccggctcaaaagctcccccactgagtaccttgtgacccccactctgccggccagagaacacccccctttgactgtaattttcctttatctacccaaatcctataaaacggccccacccctatttcccttcgctgactctctttttggactcagcccacctgcacccaggtgaaataaacagctttattgctcacacaaagcctgtttgatggtctcttcacatggatgagagtgaaa

SEQ ID NO: 96 - DNA, 101 bp, Homo sapiens
actctcttttcggactcagcccacctgcacccaggtgaaataaacagccttggtgctcacacaaagcctgtttggtggtctcttcacgctgacgcgcgtga

SEQ ID NO: 97 - DNA, 4488 bp, Homo sapiens
acttggataggggagcctccactgggagatcaatcccctgtcctcctgctgtttgctccatgagaaagatccacctatgaccttgggtcctcagaccaaccagcccaaggaacttctcacattttaaatcgggtaagcagcctctttttactctcttctccaacctctgtcactatccctcaacctctttctcctttcaattttggtgccacccttcaatctctcccttctcttaatttcagttcctttccttttctggtagagacagaggagatatgttttatccatgaacccaaaactccagtgccagtcacgaacttgggaagacagtcttcccttcatgtttaatcactgtggtgacgcctgcctgattattcacccacatttcagaggtgtctgatcaccgcagggatgcttgccttgatctttcaccttggtagcaagcaccacctccccaggggggcaagtaccaccaccaaccacttctctccgtgtctctaccctctcttttctctggcttgcctccttcactatgggcaactttccaccctccattcctcctgtttctcccttatcctgtgttctcaagcacttaaaacctcttcaactcacacctgacctaaaacctaaatgccttattttcttctgcaatactgcttgaccccaatacaaactcaacaatggttccaaataaccagaaaatggcactttcaatttctccatcctacaagatctagataattcttgtcgtaaaatgggcacatggtctgagatgcctgatatccaggcattcttttacacatcagtcccaccctagtctctgttcccaatgtgacccatcccaaatcctcctttccctcccctctgtcccctcagtcccaaccccaaacgctgctaagtcttttctatcttccttttctaccgacccatctgacctctcccctcctccctagactgctccacctcagatcgcaccctgccaggctgaatcaggctccaattcttcctcagcctccgctcctccatcctataatccttctatcacctcccctcctcacacccagtctggcttacagtttcattccgtgactagccctcccccacctgcccaacaatttcctcttaaagaggtggctggagctaaaggcatagtcaaggttaatgctcctttttctttatccaacctctcccaaatcagttagcatttaggctctttttcatcaaatataaaaacccaacccagtccatggcttgtttggcaacaacccttagacgctttacagccttggacccagagggaccagaaggctgtcttattctcaacatgcattttattacctaatctgctccagacattaaatacaacttcaaaaattagaatccagacctcaaaccccccccacaacaggaattaatcatccttgccttcaaggtgtacaataatagagaggaggcagctagacagtaatgcatttctgagttacaattacttgcctctgctgtgagaaaaaacccagccatacctccagcacacaagaacttcaaaatccctaagccacacatgcctaagctgcagtggtcaagcattcctacaggacctcctccatcaggatcttgcttcaagggccagaaatctggccactgggccaaggaatgctcacagcccaggattcctcccaagcagtgtcccatctgtgcagggacccactggaaatcagactgcccagctcacccagcagccactcctagagcccctaaagctctggcccaaagttctctgactgactgactccttcccagatctgctcagcttagtggctgaagacttacactgcccaatcacctcgaaagccccctggaccatcacgcatgcctagcttcaggtaactctcacagtggagggtaagtccgtcccctgcttaattgatatgggggctaccctctccacattaccttcttttcaaggggctgtttcccttgcccccataactgttgtgggtattgacggccaagcttcaaaatcccttaaaactcccccactcttgtgccaacttggacaacattcttttatgcactcttttttagttatccctacctgccctgttcccttattaggctgagacattttaaccaaattatctgcttccctgactattcctggactacagccacagctcattgccacccttcttcccaacccaaagcctcctttgcatcttcctctcatatcccactaccttaacccacagatatgggacacctctactccctccctggcaaccaatcacacacccattactaacccattaaaacctaatcacccttaccccactcaatgccaatattccatcccacagcaggctttaaaaggattaaatcctgttatcaattgcctgttacagcatggcctcctaaagcctataaactctctttacaattcccccattttacctgtccaaaaactggacaagtcctacgggtaagttcaggatctccaccttatcaaccaaattgttttgcctatccaccctgtggtgcccaaccggtacactcttttgtcctcaatacctccctccacaactcactattccattcttgatcttaaaggtgctttttccattattcccctacacccctcatcccagcccctctttgcttttacttggactgaccctgacacccatcagtctcaacaacatacctaggctgtattgctgcaaggcttcaggaacagcccccattacttcagtcaagccctttctcatgatttactttctttccgtccgtctgcttctcaccttattgaatattttgacaaccttctactttatagcccctcctacaaatcttcccaacaggacaccctcctgctcctccaacatctattctcaaaagaatattgcgtatctccctccaaagcccaaatttcttcctcatccattacctatctcagcataattcttaataaaaacacacgtggtctccctgctgatcatgtccggctaatctcccaaaccccaaccccttctacaaagtaacagctgctttccttcctaggcatggtcaggtactttcacctttggatacctggttttgccaacctgactaaaccattacataaactcacaaagtaaacctagctgaccccatagatcctaaatcctttcaccattcttctttccattccttaaaaacagccctaaaatctgctcccaccctagatctccctaactcatcccaacgcttttcattacacacagacaaagtgcagggctgtgcggtcaaaattcctacacaagagctgggaccgcaccctgtagcctttctgtccaaacaacttgacattactgttttaggctggcccccacattattcctaataccacacctgacccccacggctgtatctctctgatccacctgacattcactccatttccccatatttccttctttcctgttcctcaccctgatcacacttggtttactaatggcagttccaccaggcctaatctccactcaccagcataggcaggttatgctatagtatctttcacatctatcattgaggctaccattctgtccccatccactacctctcagcaagccaaactcattgccttaactcaggccctcactcttgcaaaaggactacacgtcaatattcatactgactctaaatatgcctcctatatcctacaccaccatgctgttatatgggctgaaagaggtttcctcactacgcaaggatcctctatcattaatgcctctttaataaaaactcttctcaaggctgctttacttccaaaggaagctggagtcattcactgcaagggccatcaaaagacatcagatcccattgctcaggccaatgcttatgctgataaggtagctaaagaagcacctagcgttccaacttctgtccctcactgccagtttttctccttctctttggtcactcccacctactcccccactgaaacttccaccaatcgatctcttcccatacaaggcaaatggttcttagaccaaggaaaatatctccttccagcctcacaggctcattctattctgtcatcatttcataacctcttccatgtaggttataagccactagcctgtctcttagaacctctcatttcctttccatcatggaaatctatcctcaaggaaatcacttctcagtgttctatctgctagtctactactccccagggattgttcaggccccctcccttccctagacatcaagctcagagatttgcccctgcccaggattggcaaattgactttactcacatgcccacagtcaggaaactaaaatacttaaaatagattttccactacctatccaaatcctataaaactgccccacccctatctccctttactctcttttcagactcagcctgtctgcagctaggtgattaaaaagctttatttctcacacaaagtctgtttggtggtctcttcacacagacacaggtga

SEQ ID NO: 98 - DNA, 7777 bp, Homo sapiens
gtcaggcctctgagtccaagctaagccatcatatcccctgtgacccgcatgtatacatccagatggcctgaagcaactaaagatccacaaaagaagtgaaaatagccagttcctgccttaactgatgacattccaccattgtgatttgttcctgccccaccctaactgatcaattgactttctgacaatacaccctccccacccttgtgataactactttgtgatattcccccacccttgtgaatgtactttgtatgatacaccctccccacccttgagaaggtaatttgtaatatcctcccctacccttaacaaggtactttgtaatattctcccccacccttaagaaggtactttgggccgggcgcggtgtctcacgcctgtaatcccagcactttgggaggccgaggtgggtggatcacgaggtcaggagattgagaccatcctggctaacatggtgaaaccccatctctactaaaaatacaaaaaaaattagctgggtgtggtggcgggcacctgtagtcccagctactcgggaggctgaggcagaagaatggcgtcaacctgggaggtggagcttgcagtgagccaagattgcgccactgcactccagcctgggcaacggagcaagactccgtcaaaaaaaaaaaaaagtactttgtaatattctccccatccttgagaatgtacttggtaagatccaccccctgcccacaaaacattgctcctaactccattgcctattccaaacctataagaactaatgataatcccaccaccctttgctgactctctttttgggctcagcccacctgtacccaggtgattaaaaagctttattgctcacacaaagcctgtttggtggtctcttcatacagacacacgtgacatttggtgccaaagacccgggggagggggactccttcgggagaccagtcccctgtcctcaccctcactccatgaggagatccacctaccatcttgggtcctcagaccaaccagcccaaggaacatctcaccaatttcaaatcaggtaagcggtcttttcactctcttctccaacctctcttgctgttgctccacccttcaatctctcccttccttaattttggttcctttccctttctggtagagacagaagagacgtgttttatccataaactcaaaactccagcgctggtcactccagacagtcttccgttggtgtttaatcactgtggggatgcctgcctgattattcacccacatttcagggatgtctgatcactgcggggatgcctgccttgatccttcaccttggtggcaagtaccacctcccctgggtggcaagcaccacctcccctgggtggcaagtaccactccctcctcctccatgtctctaccctctcttttctctgggcttgcctccttcactatgggcaaccttccaccctccattcctccttcttctcccttagcctgtgttcttaagaacttaaaacctcttcaactctcacctgacctaaaacctaagcattttattttcttctgcaacattacttggtgtcaatacaaacttgataatggctctaaatggccagaaaatggcacttttgatttctccattctacaagacctagataatttttgtcaaaaaatgggcaaacggtctgagatgcctgatgtccaggcattcttttacacctcggttcctccctagtctctgctcacaatgcgacccatcccaaatccttctttctctcctgactgttccttcagtctccaccccaagctctgagtcctttgaatcctcctttactacagactcatctgacctctcccctcctccccaggctgctcctcgccaggctgagccaggtcccaattcttcctcggcctccactcccccaccctataatccttctatcacctcccctcctcacacctggtctggcttacagttttgtaccgcaactagccctccgccacctgcccaacaatttcctctcaaagaggtggctggagctaaaggcatagtcaaggttaatgctcctttttctctatcagacctttcccaaatcagttagcatttaggctctttttcaccaaatataaaaacccagcccagttcatggcccatttggcaacaacccttggatgctttactgccctagacccagaggggccagaaggctgtcttattctcaatatgcattttattatccaatccagtcccgatattagaaaaagttccaaaaattagattccggccctcaaaccccacaaaagaacttaattaacctcgccttcaaggtgtacaataataaaaaagaggcagccaagtgccaacatatttctgagttgcaattacttgcctccactgtgagagaaaccccacccacacatttctagcacacaagaactttgaaactcctaaaccacagcagccaggcattcctccaggacctcctcccccaggatcttgcttcaagtgctggaaatctggccactgggccaacgaatgcccacagcctgggattcctcctaagccatgtcccatctgtgcggaccccactggaaatcagactgtccaattcgcctagcagccactcccagagcccctggaactctggcccaaggctctctgactgactccttcccagatcttctcagcttagtggctgaagactgacgctgcccgatcaccttggaaacctcctggaccatcacagctttaggtaactcttacagtggagggtaagtccatccccttcttgatcaatatggaggctacccactccacattaccttcttttcaagggcctgttccccttacctccataactgttgtgggtattgacggccaggctgcgagaccccttaaaactcccccactctggtgccaacttggacaacattcttttatccactcctttttagttatccccacttgcccagttaccttattaggtcaagacattttaactaaattatctgcttccctgactattcctgggctacagccacacctcactgccacccttttccccagttcatagcctccttcgaatcctccccttgtatctccctaccttaatccacaagcatgggatccctctactccctccttggcgactgatcatgcaccccttatcatcccattaaaatctaatcacccttaccatgctcaacgccaatatcccatcccacagcaggctttaaaaaggttaaagcctgttaccaccagcctgttacaacatggcctcttaaagcctacaaactctccttacaactctcctatcctacctgtccaaaaaccagacaagtcttacaggctggtccaagatctttgccttatcaaccaaattgtcttgcctatccaccccatagtgccaaacccatatactctcctatcctcaatacctccctccacaacccattattctgttctggatctgaaacatgctttctttactattcctttacacccttcatcccagcctctcttcactttcacttggactgaccctgacacccatcagtcccagcaacttacctgggctgtactgccacaaggcttcagggacagcccccattacttcagtcaagccctttctcatgatttactttctttctgtccatctgcttctcaccttattcaaaattttgacaaccttctcctttatagcccaccctacaagtcttcccaacagggcaccctcctgctcctccaacatctattctcaaaaggatattgcatatccccctccaaagcccaaatttcttcctcatccgttacctatctcagcacctttcttcataaaaacacacgtgctctccctgctgattgtgtccggctaatctcccaaaccccaaccccttctacaaacaacaactcctttccttcctaggcatggttaaggtactttctcctttggatatctggttttgccatcctgactaaaccattatataaactcacaaaaggaaacttagctgaccccataaatcctaaatcctttccccattcccctttccattccttaaaaaacaaccctaaaagctgctctccctaactcatcccaacccttttcattacacacagctgaagtacagggctgtgcagtcagaattcttacacaagagctgggactgcaccctgtagcctttctgtccaaacaacttgaccttactgttttagactagccctcatctctgtgtgcagcagctgctgctgctctaatacttttagaggccttcaaaatcacaaactatgcttaactcactccctacagttctcataacttccaaaatctattttcttcctcacacctgatgcatatactttctgcccctggctccttcagctatattcactctttgttgagtctgcaacgattaccattgttcctggcccggacttcaatccagcctcccacattattcctgataccccacctgacccccataactgtatctctctgatctaacttgtattcactccatttccccatatttccttctttcctgttcctcaccctgatcacacttggtttattgatggcagttccaccaagcctaatcaccaatcactagcaaaggcaggctatgctatagtatcttccacatctatcattgaggctactgctctgccccactccactacctctcagcaagccaaactcattgccttaactcgagccctcactcttgcaaaaggactacgcatcaatatttatacagactctaaatatgccttccatatcctgcaccatcatgctgttatatgggctgaaagaggtttcctcattacacaagggtcctccatcattaatgcatctttaataaaaactcttctcaaggccgctttacttccaaaggaagctggagtcattcactgcaagggccatcaaaaggcatcagatcccattgcttagggcaacgcttatgctgattaggtagctgaagaagcagctagcattccaacttctgtccctcatggccagtttttctccttctcatcagtcactcccacctactctcccactgtaacttccacctatcaatctcctctcacacaaggcaaatggttcttggaccaaggaacatatctccttccagcctcacaggcccattctattctgtcatcttttcagaacctcttccatgtaggttacaagccactagcctgcctcttagaacctctcatttcctttccatcgtggaaatctatcctcaaggaaatcacttcttagtgttccatctgctattctactactactcagggattgttcaggcccgctcccttccctacacatcaagctcagggatttgcccctgtccaggactggcaaattgatttacttacatgccctgagtcaggcaactaaaatacctcttggtctgggtagacactttcactggatggatagaggcctttcccacaggatctgagaaggctaccgcagtcatttcttccctttttccagacataattccttggtttggccttcctacctctatacagtctcatcacagaccagcttttattagtcaaatcacccaagcagtttctcaggctctattcagtggaagcttcataccccttaccgtcctcaatcttcaggaaaggtagaacggactaatggtcttttaaagacacacctcaccaagctcagcctccaacttaaaaaggactggacagtacttttacctcttgcccttctcagaattagagcctgtcctcgagatgctacagggtacagtccatttgaacttttatatggatgcactttcttgctcggacccaaccttgccccagacaccagccctctaggcgactatcttccagtcttccagcaggctagacaggaaatttgccaggctgctcatcttctcttgcctactccagattcccagccatatgaagacaccctagctggatgataagttcttgttaaaaatctgacccttcaaactctacaacctcgatggactggaccctacttagtcatctctagtaccccaactgctgtccgcctgcaggaccctccccattgggttcaccattccagaataaagctttgtctgtcagacagacagcctgatctctcctcttcctcctggaagtcgcaagtactcaaccctacttcccttaaactcacccgcattcctaaatgataatagtaacccttataagcctaatacatcctatcatttttattaggtctcttcgtccttaccctactcttcccaacaaagctttacgcattcacccctcccacttggattgcaccccaaaaacttgtcatccctactatcttctgtctagtcatattcctattcaccattctcaactactcataagtgtcgtgcccctgtttacactgccagtttacatttttcctccaaaccatcacagcggatatctcctagtactatccccaatccgccactcttgactccctcttggagtggatagatgatctttgctcacagggcacactccaatactttcaccctgatgaagtcctattctttacttttacactcactcttattctcattcccgttcttgtgccaccctctacctctccccagctacctccaccacactatcaatctcactcactctctcctagccgtttctaaaccttctttaacaaacgattgttggctttgcatttctttttcctccaaaatcgccgaggctttgacttactgctaaaaaaaaaggggactctgtatattttttaaaagaagagtgttgcttttacctaaatcaatctggcctggtatatgacaacatcaaaaactcaaggattgagcccaaaaactcaccaaccaagcaaataattacactgaacccccttgggcactctctaattggatgtcctgggtcctcccatttcttagtcttttaatatctgtttttctccttctcttatttggaccttgtgtcttctgtttagtttctcaattcatacaaaactgcatccaggccatcaccattctatatgacaaatgttccttctaataaacccacaatatcaccccttaccccaaaatctttctttaatctttcccactccaggttcccatgctgcccctaatcctgctcaaagcagccatgagaaaaattgcccattatctctccataccacccccaaaaatattttgccgccccaacacttcaccgctattttgttctatttttcttattaatataagaagacagaaatgtcaggtctctcagctgaatctaagccatcatatcccctgtgacctgcacatatacatccagatggcctgaagcaacttaagattcacaaaagaagtgaaaacagccagttcctgccttaactgatgacattccaccgttgtgatttgttcctgccccaccctaactgatcaattgactttgtgacaatacaccctccccgccctcgcaataatgtactttgtgatattcccttgcctttgtgaatgtactttgtactatacaccctccccaccattaagaaggtactttgtaatattctcccccacacttaagaaggtactttgtaatattctccacatccttgagaatatactttgtaagatccacccgctgcccgcaacaaaattgctcctaactccaccgcctatcccaaacgtataagaactaatgacaatcccaccaccctttgctgactctcttttcggactcaggctgcctgcacccaggtgattaaaaagctttattgcttacacaaagcctgtttggtgatctcttcacacagacgcgcgcatgaaa

SEQ ID NO: 99 - DNA, 401 bp, Homo sapiens
gtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcacacaaagcctgtttggtggtctcttcacacagacacgagtgaaa

SEQ ID NO: 100 - DNA, 354 bp, Homo sapiens
ccacaaaaaaagtgaaaatagccagttcctgccttaactgatgacattccaccattgtgatttgttcctgctccaccctaactgatcaattgaccttgtgacattccttctcctggacaatgagtctcagaatctccccactgagcactttgtgacccttgcccctgcccacaagaaaaagaaaccctttaactgtaattttccattacctacccaaatcctataaaactgccccaccccatctccctttgctgacctctttttcagactcagtccgcctgcacccaggttattaaaaagctttattgctcacgcaaagcctgtttggtggtctcttcacatagacacatgtga

SEQ ID NO: 101 - DNA, 2747 bp, Homo sapiens
taggtcaggtgcaaagtaagcccaccccactaggaactatcttgaaaaatttcaagaaaggatttaagggagattacagtgttactatgacaccaggaaaacttagaactttgtgtgaaatagactggccagcattagaagtaggttggccatcagaaggaagcctggacaggtctcttgtttcaaaggtatgacacaaggtaactggtaagccaaggcacccagaccagtttccatacatagacagttacagctggttttagacccccttccccaccacagtagttaagagaacagcagcataagcagctggcagaggcaaggaaagaccagcagagagaaaaagagaccatctataccaattctaagttaatttagactaaacaaagtcttattaatagcaaaggataattgaaatcccaaactgacaaggttttcaacaaaagtgaagtttgctaaaagttaacagtgtaacatgtattatggtaacttctaatcttgtggccttagacaatctagttcaaagacataaagaaagttcgctttaaaaaaaaaaaaaaggaatggttatcttcaaaaagaaaaaaaaaaaaggaaaaaaacggggagaggcagaatttatgtaaaaagagtgttacatggtaaattcttgtcctgaaataaattaactggttgtttaaaaaaaaaatgtaataagtcagaaagttaagacatgttgaaaaattgtctgcaaaagtcgtgaaagaaaaagttataaaaagtatttatgcaaaaaagttgtataatttaaaagtaataaggcctcctgagtactattttaaaaaaacagtttatgtgcaaggtgtataagaaaagtaaaatatacctttggtaaaaaagattataaaagggcataaaaatgtggatttttacctacattaaaaagttaaaaaaattgttttaaaagtttaagcaagttttaaaacattaattgtaaagaaaattctgtgtgtaaacatattagctaaagttaaaaaggtgtcatccagtttttctgtgaactagacattaaaaatgcaacaggtttttcttaaaggatcaacctgttctttaacaaaaattataaaaagttaaaaagagtctataaaatcttacatggtcaaacataaaaaattggataaatatgtctacaaggttttattaaaattaagtttaacattaacactaatataaaggtaaaatttaacttatgtggtataaaaatcatacaagaagcattattaaatataaaatggtgtttagctttctttggtctaaaaactaataaaaataggtgctacaggaaacattcattttactaaaggatcatagaagctaaagacttaaaacaaactttggcaattaagacagcataccaagatgcaaatgcctggttgaaatagatcaaatattccatctgcacgttaaacaaaagcaattgttatgcttgtgcacatggcaggccagaggccctgattgtcccccttccactaaggtggtcctctagtcgaccaggcataggctgcatggtagctcttttccgggactctatagcctggagtaaaaagtcatgccaagctctctctgctatatcccgaagtccctgcgggtcagcccctgagggccatccagcttccatctcccaacactaagttcacttcgtgtctgtcacagcaaggaagagacttagcattccttagagacctgaagggatgcagtgagcttaagaattttcaagagcttatcaatcagtcagcccttgttcgtcccctagcagatgtatggtagtattgtggtggacctttactaggcactctgcctaataactagagtggcacttgtgctttagtccatttggctatccctttcaccctggcatttcatcaaccagaggaaaaacaaaaaataagacatcataaagcgagagaagccccttataggtctttcaactctcacatctatttagatgcaattagagccccgcaaggaataccagatcaatttaaagcttgaaatcaaatagaggattcaagtcaatattttagtagatgacagtcaataaaaatgtagattagataaactacatctattacaaccaacagcaatgagcttttcatgagttaaaaagaaaaactcatgtcggtcccagccctgaggctacctgacctgacaaaactctttacactctatgtgtcagaaagaaaaaaaaaatggcagttggagttttaacccagactttggggccctggccaaagccagtggcctatctctcaaaacaactagacagggtttccaaaggctggcccccatgtccaagggccctggtagcaacggccctgttagcacaagaagcagataagctaactcttagacaaaacctaaagtccccccatgctgtggtgattttaataaataccaaaggacaccattagctaatgaatgctagactaactagataccaaagcttgctctgtgaaaatccccacataacgattgaagtttgcaacaccctaaccctgccatcttactcctggtatcagagagcccagttaaacataaactgtgtagaggtgttggacttagtttattctagtaggcccaacctccaagaccacccttaaacatcagtagactgggagctgtacgtggatggaagcagcttcgccaacccctgcaaagtgactctgaagaagacgacaagccctgccccagtcacacccggaagctga

SEQ ID NO: 102 - DNA, 7546 bp, Homo sapiens
gtggggaaacgaaagagatcaggctgttactgtgtctatgtagaaagaagtagacataagagactctattttgttctgtactaagaaaaattcttctgccttgagatgctgttaatctgtaaccctaccccaaccctgtgtcgcagagacgtgctgtgttgactcaaggtttaatggatttagggctatgcaggctgtgctttgttaaaaaagtgcttgaaggcagtatgcttgttaaaagtcattaccattctctaatttcaagtacccagggacacaatacactgcggaaggctgcagggacctctgcctaggaaagccaggtattgtccaaggtttctccccatgtgatagcctgagatatggccttgtgggaagggaaagacctgaccgtcccccagcccgacactgtcccccagcccgacaccccacccgtaaagggtctgtgctgaggagcattagtaaaagaggaaggcctctttgcagttgtgataagaggaaggcatctgtctcctgcttgtccctgggcaatagaatgtctgggtttaaaacccgattgtatgttctatttactgagataggagaaaacagccttagggctggaggtgagaggtgctagcgacaatactgctctttaatgtttgtatacatgcacatcaaggcatagcacctttccttatttatgacacagagacatttgttcacatgttttcctgctgaccctctcctctctattaacttattgtcctgccacatccccctctccagatggtagagataatgatcagtaaatactgagggaactcagagactgttgccggtgggggtcctccgtatgctgagcaccggtcccctgggcccacttttttttctctatacgttgtctctgtctctcctgcctcagcctcctgagtagctgggactacaggcacccgccactgggcccggctaattttttgtatttttagtagagatggggtttcaccctgttagccaggatggtctcgatctcctgacctcgtgatccaccggcctcggcctcccaaagtgcggggattacaggcgtgacccaccgcacccagcctcttatttcttttctcagtctctcgtcccacctgatgagaaacgcccacaggtgtagaggggctggccaccccttcatctggtgcccaacgtgggtgcttttctctagggtgaaggtgagctagagcgtggtcattgagaacaagttgatgagagattcccgagtacgtctacagtcagtcttgtggtaagcttgtgccctcggaagaacctagggtaacaatggggcaaactgaaagtaaatatgcctcttatctcagctttattaaaattcttttaaaaaggggggagttagagtctctacaaaaaaatctaatcacgctatttcaaacagtagaacaattctgcccatggtttctagaacagggaactttagatctaaaagattgggaaaaaattggcaaagaattaaaacaagcaagtaggaagggtaaaatcatcccacttaccgtatggaatgattgggccattattaaagcagctaatttagaactgtttcaaacaggagaagatagcgtttcagttgctgatgcccctgaaagctgtgtaatagattgtgaagaataggcagggatagaatcccagaaaggaatggaaagttcaaaagttcacattgtaaatatgtagcagagtctgtaatggctcggtcaatgcaaaatgttgactacaatcaattacaggaggtaatatatcctgaagcattagaattagaagaaaaaggtccagaattagcggggccatcagagtctaaaccatgatggccaactcctcttccagcggttcagatgcctgtaacattacaacctcaaatgcaggttagacaagtacaaaccccaagagaatatcaaatagagagtctctgtcatggcaacgccaatccaaatacagtatccacaatatcagccggtagaaaataagacccaaccgccagtagcctatcaatactggccgccagccgaacttcagtatcggccgcccccagaaaatcagtatggacagccaggagtgtttccagcaccacagggcagggcgctatagcctcagccgcccactataagactttatcctacagcaccacctagtggacaaggtagtgcattacataaaattattgataaggcaaggaaacaaggagatattgaggcgtggcaattcccagtaccgatgccacctggagaaggggcccaagaaggagcgcctaccctagttggggccagatatgagtccttttctataaaaatgttaaaagatatgaaagagggagtaaaacagtatggacccaactccccttatatgagaacattattaggttccactgctcatggacatagactcattccttatgattgggagattttggccaaatcatcactctcactgtctcaatttttacaatttaagagttggtggattgatggggcacaagaacaggtctgaagtaatagggctgccaatcctccagttaacatagatgcagatcaactattaggaaaaggtcaaaattggagcactactaatcaacaagcaataatgcaaaatgaggccattgagcaagttagagctatctgccttagggcctgggaaaaaaatccaagacccaggaaccacctgcccctcattcaatacaataagacaaggctctaaaaagccctaccctgattttgtggcaaggctccgagatgctgctcaaaagtcaattaccgatgaaaatgcccgtaaggtcatagtggagttgatggcatatggaaacgccaatcctgagtgtcaatcagccactaagccattaaaagggaaggttcccacaggatcagatgtaatctcagagtacgtaaaagcctatgatggaattggaggagctatgcataaaactatgcttatggctcaagcaataatgggagttgctttaggaggacaagttagaacatttgggggaaaatgttataattgtggtcaaattggtcatctaaaaaagaattgcccagcctcaaaaaaacaaaatataactattcaagctactacaacaacaacagataaagagccacccgacttatgtccaagatgtaaaaaagaaaaacactattagaattctatcaaattctaaatttgatagaaatgggcaactattgtcaggaaacagcaaaggggccagcctcaggccctgcaacaaactggggcattcccagttcagccctttgttcctcagggttttcagggacaacaacccccactgtcacaagtgcctcagggaatgagccagttaccacaatacaacaattgtcccctgccacaagcggcagtgtagcagtagatttatgtactatacaagcagtctctctgctttcaggggagcccccacaaaaaattcccacaggggtatatggccccctgcctgaggggactgtaggactaatcttaggaagatcaagtctaaatctaaagggagttcaaattcatactggtgtggttgattcagactacaaaggtgaaattcaattggttattagctcctcaattccttgcagtgccagtccaggagacaggattgctcagttgttactcctgccttatattaaggttggaaacagtgagataaatagaaaggagggtttggaagcactgatccggcaggaaaggctgcatattgggcaagtcagttctcagagagcagacctgtgtgtaaggccattattcaaggaaaacagtttgaagggttggtagacactggagcagatgtctctatcattgctttaaaccagtggccaaaaaattggcctaaatgaaaggctgttacaggacttgtcggcgtaggcactcctcagaagtgtatcaaagtactattacattgtttagggccggataatcaagaaagtactgttcaaccaatgattacttcaatgattacttcaaccaatgattacttcatctgtggggttgagatttattacaacaatggggtgcagaaatcactatgcctgctccattatacagcctcaggagtcaaaaaatcatgactaatatgggatatataccaggaaagggactaggaaaaaatgaaaatggcattaaagttccacttgagactgagagaaatcaagaaagaaaaggaatagggtatcctttttaggggtggccactgtagagcctcctaaacccattccattaacttggaaaacagaaaaaccggtatgggtaaatcagtggccgctaccaaaacaaaaactggaggctttacatttattagcaaaggaacaattagaaaagggacatattgagccttcgttctcgccttggaattctcctgtgtttgtaattcaaaaaaaatccggcagatggcataagttaactgacttaagagccgtaaatgccgtaattcaacccatggggcctctccaacccgggttgccctctctggccatgatcccaaaagactggcctttaattataattgatctgaaggactgcttttttaccatccctctggcggagcaggattatgaaaaatttgcctttactataccagccataaataataaagaaccagccaccagatttcagtggaaagtgttacctcagggaatgcttaatagtccaactatttgtcaagctcttcaaccagttagagacaagttttcagactgttatatcattcactatgttgatgatattttatgtgctgcagaaatgagagacaaattaattaactgttatacatttctgcaagcagaggttgccaatgctggactggcaatagcatctgataagattcaaacctctactccttttcattacttagggatgcaaatagaatatagaaaaattaagctacaaaaaatagaaataagaaaagacacattaaaaacattaaatgactttcaaaaattgctaggagatattaattggattcggccaactctaggcattcctacttatgtcacgtcaaatttgttctctatcttaagaggagacccagatttaaatagtaaaagaatattcactccagaggcaacaaaaaaaattaaattagtggaagaaaaaattcaaccagcacaaataaatagaatagatcccttagccccactccaacttttgatttttgctactgcacattctccagcaggcatcaatgttcaaaatactgatcttgtggagtggtcattccttcctcacagtacaattaagacttttacattgtacttggatcaaatagttacattaattggtcaggcaaaattacgaataataaaattgtgtggaaatgacccagacaaaatagttgttcctttaaacaaggaacgagttagacaagcctttatcaattctggtgcatggcagattggtcttactgattttgtgggaattactgataatcattaccccaaaacaaaaatcgtccagttcttaaaattgactacttggattttacctaaaattacgagacatgaacctttagaaaatgctctgacggtgtttactgatggttccagcaatggaaaggcagcttacatagggccaaaagagcaagtaatcaaaactcattatcaatcggctcaaagagctgagttggttgcagtctttacagtgttacaagattttaatcaacctattaatattgtatcagattctgcatatgtagtacaggctacaagggatgttgagacagctctaattaaatatagcatggatgatcagttaaaccagctgttcaatttattacaacaaactgtaagaaacagaaatttcccattttacattactcatatttgggcacacactaatttaccagggcctttaactaaagcaaatgaacaagctgacttactggtaccatctgcattcataaaagcacaagaacttcatgctttgactcatataaatgcagcaggattaaaaaacaaatttgacgtcacatggaaacaggcaaaaaatattgtacaacattgcacccagtgtcaagtcctacacctgcccactcaagaggcaggagttaatcccagaggtctatgtcctaatgtgttatggcaaatggatgtcacgcatgtaccttcatttggaagattatcatatgttcatgtaacagttgatacttattcacatttcatatgggcagcttgccaaacaggagaaagtacttcccatgttaaaaaacatttattgtcttgttttgctgtaatgggagttccagaaaaaatcaaaactgacaatggaccaggatattgtagtaaagctttccaaaaattcttaaatccgtggaaaattacacatacaacaggaattccctataattcccaaggacaggccatagttgaaagaactaatagaccactcaaaactcaattagttaaacaaaacgaagggggagacagtaaggagtgtaccactcctcagatgcaacttaatctagcactctatactttaaattttttaaacatttatagaaatcagactactacttctgcagaacatcttactggtaaaaagaacagcccacatgaaggaaaactgatttggtggaaagacaacaaaaataagacatgggaaatagggaaggtggtaacgtgggggaaaggttttgcttgtttcactaggagaaaatcagcttcctgtttggatacccactagacatttaacgttctgcaatgaacccatcggagatgcaaaaaaaagcgcctccgcggagacagaaacactgcaatcgagcaccatcaactcatatgatgaacagaatggtgatgtcagaagaacagacgaagttgccatccaccaagaaagcggagccactgacttgggcacaattaaagaagctggcacagttagctaaaaaaaaaaaaaagccttgagaacacaaaggtgacacaaactccagagagtaggctgcttgtagctttttttttttttttttttttttttgagatggagtcttgctccgtcaccaggctggagtgcagtggtgcgatctcagctcatggcaacctccacttcccaggttcaagcaattctcctgtctcagcctcctgagtagctgggattacaggcgcgtgccaccacgcccagctaatttttctatttttagtagagacggggtttcaccatgttggtcaggctggtcttgatctcgtgatccacccgcctcggcctcccaaagtgctgggattacaggcatgagccaccatgcctggccgcttgcagctttgatgattgtatcaatggtggtaagtctccccatgcctgcaggagcagctgcagctaattataccactgggcctatgtggctttcccgcccttaatttgggcagtcacatggatggataatcctactgaaatatatgttaataatagtgtatgggtacctggccccacagatgatcgttgccctgccaaacctgaggaagaaggaatgatgacaaatatttccactgggtatcgttatcctcctacttgcctagggagagcaccaggatgttta

SEQ ID NO: 103 - DNA, 302 bp, Homo sapiens
tcaacccctgacctaactggttatttgcataaaaaagcactgtgaagatccctgtcctattctgctctgttctaattacaggcgtatgcaacccccagtcacttacccactgcttgctcaatcgaacacgaccctctcatgtggacccccttagagttgtgagcccttaaaatggacaggattgctcactccaggagctcggctcttgagacaggagtcttgccgatgctcccagccaaataaaccccttccttctttaacttggtgtttgaggggtttcgtctgtggctcttcccgctaca

SEQ ID NO: 104 - DNA, 1021 bp, Homo sapiens
gtggggaaaagagagatcagactgttactgtgtctgtgtagaaagaagtaggcataagagactccattttgctctgtactaagaaaaattcttctgccttgagatgctattaatctgtaaccctacccccaaccctgtgctcacagagacaagtgctgtgttaactcaaggtttaatggatttagggctatgcaggatgtgctttgttaaacaagtgcttaaaggcagtatgcttgttaaagtcatcaccagtctctaatctcaagtacccagggacacaatacactgctgaaggccgcagggacctctgcctaggaaagccaggtattgtccaaggtttttccccatgtgatagtctgagatatggcctcatgggaagggaaagacctgaccgtcccccagcctgacatgggtaaagggtctgtcctgaggaggattagtaaaagaggaagacctctttgcagttgagataagaggaaggcatctgtctccaggcatgtgtctttatagtagaatatagtagaatgatttatattattcccggagagtgatttatattattccctgggcaatggaatgtctcggtgtaaaacccgattgtatgttccatatactgagataggagaaaactgccttaaggctgcaggtgagacatgctggcggcactactctttaatgcaccagagatgtttatgtatgtgcacatcaaagtacagcaccttttctaaccttgtttatgacacagagatatttgttcacgtgttttcctgctgaccctctccccactattaccctattgtcctggaacatccccctctcttgagatggtagagataatgatcaataaatactgagggaactcagagaccggtgctggcacgggtcctccacatgctgagcgccgcccctgggcccacttttctttctctatactttgtctctgtgtctctttcttttctcagtctctcgtcccacccgacgagaaacacccacaggtgtggaggggcaggccaccccttca

SEQ ID NO: 105 - DNA, 677 bp, Homo sapiens
ttatagtaggtagtcaggcagacatgatcagggcaggagaggtccctctcactgccaccaggaatgtcaggcgaccctcaggtcaggcagttgttatactgtttctctaaaataataactggtgtcagccagtgccagggaaaggcagtctcctaatagatagaaaaacctgaaactggtgataagcagcttcctgataagatctcaggagttgggtgagtgggctcaagcacgcgcatgaagaggcaaaatggcggagttcaggtatggtatgacctaggaatactggactggtaagggaggaacaccttaagtgagcatgcatagaactccagtaaacacattgtgcatgctccctccgaaatgctggcaggccacccggcatgcggacagcccaccccaagggaagaatcaggggagaagggacgcaatctcccggaaagcatgccaacgtgtaagaccccaagtcaaaggtcaaactgcacacttgatctcccaagtcacagagagagtaacccctcttccaaggttactttacttcctttcattcctgctcaaagctttttaataaactttcactcctgctgtgtaacatttgcctcagtctctccttctgcccctcaaattctttcttctgaggaggcaagaattgaggttgctgcagacccagacagatt

SEQ ID NO: 106 - DNA, 973 bp, Homo sapiens
gtagggaaaagaaagagagatcagactgttactgtgtctatgtagaaaaggaagacataagaaactccattttgacctgtaccctgaacaattgctttgccctgagctgttaatctgtaactttgccccaatcctgtgctcacagaaacatgtgttgcatggaatcaagatttaagggatctagggctgtgcaggatgtgccttgttaataaaatgtttacaggcagtatgcttgataaaagtcatcactattctccattctggagtaaccaggggcacaatgcacggcggaaagccgcagggacctctgcacaggaaagccgggtattgtccaaggtttctccctatgtgatagcctgagatatggcctcatgagatggaaaagatctgaccgtcccccagcctgacacccgtgaacggtctgtgctgaggaggattagtaaaaggggaaggccccttgcagttgagataagaggaaggcctgtctcctgcctgccccgggaatggaatgtcttggtataaaaccctactgtacatttgttcagttctgaaataggagaaaaaccgccctgtggcgggaggcgagacatgttggcagcaatgctgctctgttactctttaccccaatgagatgtttgggtggagagaagcataaatctggcctacgtgcacatccgggcacagtaccttcccttgaacttatttgtgacacagattcctttgctcacatgttttcttgctgaccttctccccactatcaccctgctctcctactacattcctcttgctgagatagtaaaacagtaatcaataaatactgagggaactcagagaccagtgccggtgcaggtcctccatatgctgagcaccagtctcctgggcccactgttctttatactttgtctctgtgtcttatttcttttctcagtctctcgtcctacctgatgagaaatacccacaggtgtggaggggc

SEQ ID NO: 107 - DNA, 967 bp, Homo sapiens
gtggggaaaagaaagagggatcagattgttactgtgtctgtgtagaaagaagtagacataggagactccattttgttctgtactaagaaaaattcttctgccttgagatgctgttaatctgtaaccttacccccaaccctgtgctctctgaaacatgtgctgtgtcaactcagggttaaatggattaagggctgtgcaagatgtgctttgttaaacagatgcttgaaggcagcatgctccttaagagtcatcaccactccctaatctcaagtacccaggcaaacactgcggaaggcttcagggacctctgcctaggaaagccaggtattgtccaaggtttctccccatgtgatagtctgaaatatggcctcgtgggaagggagagacctgaccatcccccagcccgacacccgtaaagggtctgtgctgaggagaattagtaaaagaggagggaatgcctctttgcagttgagacaagaggaaggcatctctctcctgcgcgtccctgggcaatggaatgtctcagtgtaaaacccaattgtatattccatctactgagataggggaaaaccgcctcaggggtggaggtgggacatgcggtgggcaatactgctctttaaggcattgagatgtttatgtgtatgcatatctaaagcacagcacttaattctttaccttgtctatgatgcagagacctttgttcacctgtttatctgctgaccttctctccactattatcctatgaccctgccacatccccctctctgagagagaaacacccaagaatgatcaataaatactaagggaactcagaggctggcaggatcctccatatgctgaacgctggtcccctgggcccccttatttctttctctatactttgtctccgtgtctttttcttttccaagtctcttgttccacctaacgagaaacacacacaggtgtggaggggcaacccgccccttca

SEQ ID NO: 108 - DNA, 970 bp, Homo sapiens
agggaaaagaaagagagatcagactgtcactgtgtctatgtagaaaggaaagacataagagactccattttgaaaaagacctgtcctttaaacaattgctttgctgagatgttgttaatttgtagctttgccccagccactttgccccaacctggagctcacaaaaacatgtgttgtatgaaatcaaggtttaagggatccagggcggtgcaggacgtgccttgttaacaagatgttcacgagcggtatacttggtaaaagtcatcgccatcctctagtctcaataaaccaggggcacagtgccctgcggaaagccgcagggacctctgctcttgaaagccgggtattgtccaaggtttctccccatgtgatagtctgaaatatggcctcgtgggaagggaaagagctgaccatcccccagctcaacacccataaagggtctgtgctgaggaggattagtaaaagaggaaggcctctttgcagttgagataagaggaaggcatctgtctcctgctcgtccctggacaatagaatgtctcggtgtaaaccgattgtatattccatctactgagatagggtaaaactgccttatggctggaggtgggacatgctggcggcaacactgctctttaaggcgttgagatgtttatgtatgtgcacatcaaagcacagcacttttttctgtaccttgtttatgatgcagagacatttgttcacgttttcctgctgaccctctctccactattaccctattgtcctgccacatccccctctccccgataatgatcaataagtactaagggaactcagaggcaggtgccggcgcgggtcctctgtatgctgagcgccggtcccctgggcccatttttctttctctctactttatctctgtgtctctttcttttttcaagtctctcgttcctcctgatgagaaatgcccacaggtgtggaggggcaggccaccccttca

SEQ ID NO: 109 - DNA, 451 bp, Homo sapiens
gtcaggcctctgaggccaagccaagtcatcgcatcccctgtgacttgcgcgtatatgcccagatggcctgaagtaactgaagaatcacaaaagaagtgaatatgccctgccccgccttaactgatgacattccaccacaaaagaagtgtaaatggccggtccttgccttaagtgatgacattaccttgtgaaagtccttttcatggctcaccctggctcaaaaacacccccactgagcaccttgcgacccccactcctgcccgccagagaacaaaccccctttgactgtaattttcctttacctgcccaaatcctataaaacggccccacccttatctcccttcactgactctcttttcagactcagcctgcctgcacccaggtgaaataaacagccatgttgctcacacaaagcctgtttggtggtctcttcacacggacacgcatgaaa

SEQ ID NO: 110 - DNA, 905 bp, Homo sapiens
gtgtctatttagaaaaggaagacttaagaaactccattttgatctgtaccctgaacaatggttttgccttgagatgctgttaatctgtaacttttctccagccttgtgctcacagaaacatgtgttgtatggaattaaggtttaagggatctagggctgtgcaggatgtgccttgttaacaatatgtttacaggcagtatgcttggtaaaagtcatcgccattctccattctcgattaaccaggggcacgatgcactgcggaaagccgcagggacctctgcccaggaaaaccgggtattgtccaaagttcctccccactgagacagcctgagatatgtcctcatgggatgggaaagacctgaccgtcccccagcccgacacccgtgaagggtctgtgctgaggagaattagtaaaagaggaaggcctctgtctcataccgaacggaatgtctcggtataaaacccgattgtagaaaaccacactggcaggaggcgagatatgctggcggcaattattctttattctgttattctttactacactgagatgtttgggtggagagaagcataaatctggcctacgtgcacatccaggcatagtaccttcccttgaacttatttgtgacacacattcctttgctcacgttttcttgctgaccttctccccactatcaccctgttctcctgccgcttcctcttgctgagatagtgaaaatagtaatcaataaatactgagggaactcagagaccggtgctggtgcaggtcctccgtatgctgagcgccagtctgctgggcccactgttctttctctatactttgtctctgtgtcttacttcttttctcagtctctcgtcccacctgacgagaaatacccacaggtgtggaggggcaaaccaccccttca

SEQ ID NO: 111 - DNA, 9122 bp, Homo sapiens
gtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacaggtgctgtgtcaaactcagggttaaatggattaagggttgtgcaagatgtgctttgttaaacaaatgcttgaaggcagcatggtccttaagagtcatcaccactccctaatctcaagtacccagggacacaaacactgcggaaggccgcagagacctctgcctaggaaagcaaggtattgtccaaggtttctccccatgtgatagtctgaaatatggcctcgtgggaagggaaagacctgaccgtcccccagcctgacacccgtaaagggtctgtgctgaggaggattagtgtaagaggaaggcatgcctcttgcagttgagacaagaggaaggcatctgtctcctgcccgtccctgggcaatggaatgtctcggtataaaacccgattgattgtacgttccatctactgagataggaagaaaacgccttagggctggaggtgtgggacaagccggcagcaatactgctttgtaaagcattgagatgtttatgtgtatgcatatctaaaagcacagcacttgattctttaccttgtctgtgatgcaaagacctttgttcacgtgtttgtctgctgaccctctccccactattgtcttgtgaccatgacacatccccctctcagagaaacacccacgaatgatcaataaatactaagggaactcagagacggcgcggatcctccatatgctgaacgctggttccctgggtccccttatttctttctctatactttgtgtctttttcttttccaagtctctcgttccaccttacgagaaacacccacaggtgtggaggggcaacccaccccttcatctggtgcccaacgtggaggcttttctctagggtgaaggtacgctcgagcgtggtcattgaggacaagttgacgagagatcccgagtacatctacagtcagccttgcggtaagcttgtgcgctcggaagaagctagggtgataatggggcaaactaaaagtaaaactaaaagtaaatatgcctcttatctcagctttattaaaattcttttaaaaagagggggagttagagtatctacaaaaaatctaatcaagctatttcaaataatagaacaattttgcccatggtttccagaacaaggaactttagatctaaaagattggaaaagaattggcgaggaactaaaacaagcaggtagaaagggtaatatcattccacttacagtatggaatgattgggccattattaaagcagctttagaaccatttcaaacaaaagaagatagcgtttcagtttctgatgcccctggaagctgtgtaatagattgtaatgaaaagacagggagaaaatcccagaaagaaacagaaagtttacattgcgaatatgtaacagagccagtaatggctcagtcaacgcaaaatgttgactataatcaattacagggggtgatatatcctgaaacgttaaaattagaaggaaaaggtccagaattagtggggccatcagagtctaaaccacgagggccaagtcctcttccagcaggtcaggtgcccgtaacattacaacctcaaacgcaggttaaagaaaataagacccaaccgccagtagcttatcaatactggccgccggctgaacttcagtatctgccacccccagaaagtcagtatggatatccaggaatgcccccagcactacagggcagggcgccatatcctcagccgcccactgtgagacttaatcctacagcatcacgtagtggacaaggtggtacactgcacgcagtcattgatgaagccagaaaacagggagatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaagtttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcaatgctaatggctcaagcaatgagggggctcactctaggaggacaagttagaacatttgggaaaaaatgttataattgtggtcaaatcggtcatctgaaaaggagttgcccagtcttaaataaacagaatataataaatcaagctattacagcaaaaaataaaaagccatctggcctgtgtccaaaatgtggaaaaggaaaacattgggccaatcaatgtcattctaaatttgataaagatgggcaaccattgtcgggaaacaggaagaggggccagcctcaggccccccaacaaactggggcattcccagttcaactgtttgttcctcagggttttcaaggacaacaacccctacagaaaataccaccacttcagggagtcagccaattacaacaatccaacagctgtcccgcgccacagcaggcagcgccacagtagatttatgttccacccaaatggtctctttactccctggagagcccccacaaaagattcctagaggggtatatggcccgctgccagaagggagggtaggccttattttagggtgatcaagtctaaatttgaagggagtccaaattcatactggggtaatttattcagattataaagggggaattcagttagtgatcagctccactgttccctggagtgccaatccaggtgatagaattgctcaattactgcttttgccttatgttaaaattggggaaaacaaaacggaaagaacaggagggtttggaagtaccaaccctgcaggaaaagccacttattgggctaatcaggtctcagaggatagacccgtgtgtacagtcactattcagggaaagagtttgaaggattagtggatacccaggctgatgtttctatcatcggcataggcaccgcctcagaagtgtatcagagtgccatgattttacattgtctaggatctgataatcaagaaagtacggttcagcctatgatcacttctattccaatcaatttatggggccgagacttgttacaacaatggcatgcagagattactatcccagcctccctatacagccccaggaatcaaaaaatcatgactaaaatgggatagctccctaaaaagggactaggaaagaatgaagatggcattaaagtcccaactgaggctgaaaaaaatcaaaaaaagaaaaggaatagggcatcctttttagaagcggtcactgtagagcctccaaaacccattccattaatttggggggaaaaaaaaaaactgtatggtaaatcagtagccgcttccaaaacaaaaactggaggctttacacttattagcaaagaaacagttagaaaaaggacatattgagccttcattttcgccttggaattctcctgtttgtaattcagaaaaaatccggcagatggcgtatgctaactgacttaagagccattaatgccataattcaacccatgggggctctcccatcccggttgccctctccagccatggtcccctttaattataattgatctgaaggattgcttttttaccattcctctggcaaaagaggattttgaaaaatttgcttttactataccagcctaaataataaagaaccagccaccaggtttcagtggaaagtattgcctcagggaatgcttaataattcaactatttgtcagactttcatagctcaagctctgcaaccagttagagacaagttttcagactgttatatcgttcattatgttgatattttgtgtgctgcagaaacgagagacaaattaattgaccgttacacatttctcagacagaggttgccaacgcgggactgacaatagcatctgataagattcaaacctctcctcctttccattacttgggaatgcaggtagaggaaaggaaaattaaaccacaaaaaatagaaataagaaaagacacattaaaaacattaaatgagtttcaaaagttggtaggagatactaattggattcggagatattaattggatttggccaactctaggcattcctacttatgccatgtcaattttgttctctttcttaagaggggacttggaattaaatagtgaaagaatgttacctccagaggcaactaaagaaattaaattaattgaagaaaaaaattcggtcagcacaagtaaataggatcacttggccccactccaaattttgatttttggtactgcacattctctaacagccatcattgttcaaaacacagatcttgtggattggtccttccttcctcatagtacaattaagacttttacattgtacttggatcaaatggctacattaattggtcagggaagattacgaataataacattgtgtggaaatgacccagataaaatcactgttcctttcaacaagcaacaagttagacaagcctttatcagttctggtgcatggcagattggtcttgctaattttctgggaattattgataatcattacccaaaaacaaaaatcttccagttcttaaaattgactacttggattctacctaaaattaccagacgtgaacctttagaaaatgctctaacagtatttactgatggttccagcaatggaaaagcggcttacacagggccgaaagaacgagtaatcaaaactccgtatcaatcagctcaaagagcagagttggttgcagtcattacagtgttacaagattttgaccaacctatcaatattatatcagattctgcatatgtagtacaggctacaagggatgttgagacagctctaattaaatatagcacggacgatcatttaaaccagctattcaatttattacaacaaactgtaagaaaaagaaatttcccattttatattactcatattcgagcacacactaatttaccagggcctttgactaaagcaaatgaacaagctgacttactggtatcatctgcattcataaaagcacaagaacttcttgctttgactcatgtaaatgcagcaggattaaaaaacaaatttgatgtcacatggaaacaggcaaaagatattgtacaacattgcacccagtgtcaagtcttacacctgtccactcaagaggcaggagttaatcccagaggtctgtgtcctaatgcgttatggcaaatggatggcacgcatgttccttcatttggaagattatcatatgttcatgtaacagttgatacttattcacatttcatatgggcaacttgccaaacaggagaaagtacttcccatgttaaaaaacatttattatcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcaaaacaacatcttactggtaaaaagcacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccacagagatggtaaccccagtcacatggatggataatcctatagaagtatatgttaatgatagtgtatgggtacctggccccacagatgatcgctgccctgccaaacctgaggaagaagggatgatgataaatatttccattgtgtatcgttatcctcctatttgcctagggagagcaccaggatgtttaatgcctgcagtccaaaattggttggtagaagtacctactgtcagtcctaacagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcgtgtccaagtgcacaagtgagtccagctgttgatagcgacttaacagaaagtctagacaaacataagcataaaaaattacagtctttctacccttgggaatggggagaaaaaggaatctctaccccaagaccagaaataataagtcctgtttctggtcctgaacatccagaattatggaggctttggcctgacaccacattagaatttggtctggaaatcaaactttagaaacaagagatcgtaagccattttatactatcgacctaaattccagtctaacggttcctttacaaagttgcgtaaagccctcttatatgctagttgtaggaaatatagttattaaaccagactcccaaactataacctgtgaaaattgtagattgtttacttgcattgattcaacttttaattggcggcaccgtattctgctggtgagagcaagagagggcgtgtggatctctgtgtccgtggactgaccgtgggaggcctcgccatccatccatattttgactgaagtattaaaaggcattttaaatagatccaaaagattcatttttaccttaattgcagtgattatgggattaattgcagtcacagctacggctgctgtggcaggagttgcattgcactcttctgttcagtcggtaaactttgttaatgattggcaaaagaattctacaagattgtggaattcacaatctagtattgatcaaaaattggcaaatcaaattaatgatcttagacaaactgtcatttggatgggagacagactcatgagcttagaacattgtttccagttacagtgtgactggaatacgtcagatttttgtattacaccccaaatttataatgagtctgagcatcactgggacatggttagacgccatctacagggaagagaagataatctcactttagacatttccaaattaaaataacaaattttcgaagcatcaaaagcccatttaaatttgatgccaggaactgaggcaattgcaggagttgctgatggcctcgcaaatcttaaccctgtcacttgggttaagaccatcggaagtactatgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacaggtgctgtgtcaaactcagggttaaatggattaagggttgtgcaagatgtgctttgttaaacaaatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcatgggaagggaaagacctgaccgtcccccagcccgacacccgtaaagggtctgtgctgaggaggattagtataagaggaaggcattcctcttgcagttgagacaagaggaaggcatctgtctcctgcccgtccctgggcaatggaatgtctcggtataaaacccgattgtacgttccatctactgagataggaagaaaacgccttagggctggaggtgggacatgcaggcagcaatactgctttgtaaagcattgagatgtttatgtgtatgcatatctaaaagcacagcacttgattctttaccttgtctatgatgcaaagacctttgttcacgtgtttgtctgctgaccctctccccactattgtcttgtgaccatgacacatccccctctcagagaaacacccacgaatgatcaataaatactaagggaactcagagacggcgcggatcctccatatgctgaacgctggttccctgggtccccttatttctttctctatactttgtctctgtgtctttttcttttccaagtctctcattccaccttaagagaaacactcacaggtgtggaggggcaacccatcccttca

SEQ ID NO: 112 - DNA, 5361 bp, Homo sapiens
gtcaggcctctgagcccaagccaagccatggcatcccctatgacttgcacgtatacatccagatggcctgaagtaactgaagatccacaaaagatgtaaaaatagccttacctgatgacattccagcattgtgatttgtttctgccccaccctaactgatcaatgtactttgtaatctcccccacccttaagaaggttcttcgtaattctccccacccttgagaatgtactttgtgagatccatccctgcccgcaaaacattgctcttaacttcaccgcctatcccaaaacctataagaactaatgataatccaccacaccatttgctgactctcttttcggactcagcccgcctgcatccaggtgaaataaacagccatgttgctcacacaaagcctgtttggtggtctcttcacatggacgcgcatgaaatttggtgccatgactcggatcgcgggacctcccttgggagatcaatcccctgtcctcctgttctttgctccgtgaaaaagatccacctacgacctcaggtcctcagacccaccagcccaaggaacatctcaccaattttaaatcaggtaggcggcctcttcttactctcttctccaacctctctcactatccctcaaccactttctcctttccactcttcaatctctcccttctcttaatttcaattcctttcattttctggtagagacaaacgagacacgttttatccgtggacccaaaactctggcgctggtcacagactgggaaggcagcctttccttggtgtttaatcattgcagggacacctctctgattattcactcacgtttcaaaggtgtcagaccactcagggacgcctgccttggtccttcacccttagcggcaagtcctgcttttctgggggaggggcaagtaccacaaccccttctctccgtgtctctaccccttctctgcatttctgggggaggggcaagtacccctcaaccccttctccttcacccttagcggtaagtcccgcttttctagggggcaagaacccccaatcccttatttccgcaccccgacctcttatctgtgtgccccaatcccttatttccacaccctgacccctttcctgcttttctggagggtaagaaccctcgaaccccttccctccgtgtctctactctctcttttctctgggcttgcctcctttactatgggcaaccttccagcctccattcctccttctcccttagcctgtgttctcaagaacttaaaacctcgtcaactcgcacctgacctaaaacctaaatgccttattttcttctgcaacaccgcttggccccagtacaaacttgacaatggctctaaatggccagaaaacggcactttcgatttctccatcctataagacctaaataatttttgtcaaaaaatgggcaaatggtctgaggtgcctcacatccaggcatttttcacacttcgttccctctcaagtctctgttcccaatgcgattcctcccaaatcctccttctttccctcccgcctgtcccctcagtcccaaccccaagtgtcgctgggtctttccagtcttttctacagacccatctgacctttccccttctcctcaggctgctcgtcgccaggccatctaggtcccaattcttcctcagcctctgctcctccaccctagaatccttttatcacctcccctcctcacacctggtccagcttacagtttcgttcagtgactggccctcccccacctgcccagcaatttactcttaaaaaggtggctggagctaaaggcatagtcaaggttaatgctcctttttctttatcccaaatcagaagcgtttaggctctttttcatcaaatataaaaatccagcccagttcatggctcgttcggcagcaaccctgagacgctttacagccctagaccctaagaggtcaaagggccgtcttattctcaatatacgttttattacccaatctgctcccgacattaaataaaactccaaaaattaaattccggccctcaaaccccacaacaggacttaattaacctcgccttcaaggtgtacaataatagagtagaggcagccaagtaacaacatatttctgagttgcaattccttacctccactgtgagacaaaccccagctacatctccagcacacaagaacttccaaacgcctaaaccgcagtggccaggcattcctccataactgcctcccccaggagcttgctacaagtgccagaaatctggccaccgagccaaggaatgcccgcagcccgggattcctcctaagcgagtcccatctgtgtgggaccccactgaaaattggactgttcaactcacctgacagccactcccagagcccctggaactctggcccaaggctctctgactccttcccagatcttctcggcttaacggctgaagactgacgctgcccgatcgcctcggaagccccatagaccatcacagatgccgagctttaggtaactctcacagtggagagtaagtccgtcctcttcttaatcaatacggaggctacccactccacattaccttcttttcaagggcctgtttcccttgcctccataactgttgtgggtattgacagccaggcttctaaacctcttaaaactccccaactctggtgccaacttagacaatactcttttaagcactcgtttttagttatccccacctgcccagttcccttattaggccgagacactttaactaaattatctgcttccctgactattcctgggttacagctacatctcattgctgccctttccaatccaaagcctcctttgcgtcctcctcttgtattcccccccaccttaacccacaagtataagatacctctactccctccttggcgaccgatcatgcaccccttaccatctcattaaaacctaatcacccttaccccgctcaatgccaatatcccatcccacagtatgctttgaaaggagtaaagcctgttatcacatgcctgctacagcatggccttttaaagcctataaactctccttacaattcccccattttacctgtcctaaaaccagacaagccttacaagttagttcaggatctatgccttatcaaccaaattgttttgcctatccaccccatggtaccaaaccatatactctcctatcctcaatacctccctccacaatccattattctgttctggatctcaaacatgctttctttacaattcctttgcacccgtcatcccagcctctctttgctttcacttggactgaccctgacatccattaggctcagcaaattacctgggctgtactgctgcaaggcttcacagacagcccccattacttcagtcaagcccaaatttcatcctcatctgttacctatctcggcataattctcatgaaaacacacgtgctctccctgctgatcgtgtccgattaatctcccaaacctcaatcccttacaaaacaacaactcctttccttcctaggcatggttagtgtgtcagaattcttacacaagagccaggaccgcaccctgtagtctttctgcccaaacaacttgaccttactgttttagcctagccctcatgtctgcttgcagtggctgccgctgctttaatacttttagaggccctaaaaataacaaactatgctcaactcactctctacatttctcataacttccaatattattttcttcctcatacctgatgcatatactttctgctccccggctccttcagctgtactcactctttgttaagtcccacaattaccactgttcctggcccggacctcaatctggcctcccacattattcctgataccacacctgacccccatgactgtatctctctgatccacctgacattcaccccatttccccatatttccttctttcctgttcctcaccctgatcacgcttgatttattgatggcagttccagcaggcctaatcgccacacagcagcaaaggcaggctatgctatagtacaagccactagcccgcctcttagaacctcatttcctttccattgtggaaatctatcctcaaggaaataacttctcagtgttccatctgctattctactactcctcagggattattcaggccccctcccttccctacacatcaagcttgaagatttgcccccacccaggactggcaaattagctttactcaacatgccccgagtcagataactaaaatacctcttagtctaagtagacactttcactaggtaagtagaggcctttcctacagggtctgagaaggccaccgcagtcatttcttcccttcggtcagacacaattcctcagtttagccttcccacctctatacagtctaacagaccagcccttattagtcaaatcagccaagcagtttctcaggctcttagtattcagtgaaacctttatatcccttacggtcctccgtcttcaagaaaagcagaacggactaaaggtcttttaaaaacacttcaccaagctcagccaccaacttaaaaaggactggacaatacttttaccactttcccttctcagaagtcagacctgtcctcagaatgctacaaggtacagcccatttaagctcctgtatagatgctcctttttattaggccccagtctcattccagacaccagaccaacttagactgtgcccccccccccaaaaaaaacctgtcatcatccctactatcttctgtctagtcatactcctattcaacgttctcaactactcatacatgccctgctcttgtttacactgctggtttacactgtttctccaagccatcacaggtgatatctcctcgtgctatccccaaactgccactcttaactcttgaagtaaataaataatctttgctggcaggactatgctgaatctccttaggcactctctaatcagatgtcctaggtcctcccaattcttagaccttttatacctgtttttctccttctcttattccacttagtttttcaattcatacaaaaccatatccaggccatcaccaatcattctatacgacaaatgtttcttctaacatccccacaagatctcccttcggcttaatctctcccactctaggttcccacgccgcccctaatcccacttgaagcagccctgagaaacatcgcccattctctctccataccaccccacaaaaattttcgctgccccaacacttcaacactattttgttttatttttcttattaatataagaaggcaggaatgtcaggcctgagcccaagccaagccatcgcatcccctatgacttgcacgtacacatccagatggcctgacgtaactgaagatccacaaaagaagtaaaaatagccttaactgatgacattccaccat

SEQ ID NO: 113 - DNA, 810 bp, Homo sapiens
gtggggaaaagcaagagagatcagattgttactgtgtctgtgtagaaagaagtagacatgggagactccattttgttctgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcacgctccttaagagtcatcaccactccctaatctcaagtacccagggacacaaaagctgcggaaggtcgcagggacctctgcctaggaaagccaggtattgtccaaggtttctccccatgtgatagtctgaaatatggcctcgtgggaagggaaagacctgaccgtcccccagcccgacacccgtaaagggtctgtgctgaagaggattagtataagaggaaggcatgcctcttgcagttgagacaagaggaaggcatctgtctcctgcccgtccctgggcaatggaatgtctcggtataaaacccgattgtatgttccatctactgagatagggaaaaaccgccttagggctggaggtgggacatgcgggcagcaatactgctttgtaaagcattgagatgtttatgtgtatgcatatctaaaagcacagcacttaatcctttaccttgtctatgatgcaaagacctttgttcacgtgtttgtctgctgaccctctccccacaattgtcttgtgaccctgacacatccaccttacgagaaacacccacaggtgtggaggggcaacccacccctaca

SEQ ID NO: 114 - DNA, 4779 bp, Homo sapiens
aaaaatggcacttacaatgtttccatcctacaagatcaaaataattcttgtcgtaaaatgcgcaaacggtctgacgtgcctgacgtccaggcattcttttacacatcggtccctccctagtctctgtgcccaatgcaacttgtcccaaatcttccttctttccctcccgcctgtcccctcagtcccaaccccaagcgtcgctgagtctaatcttccttttctacagacccatctgacctctcccctcctccccaggctgctcctcgccaggccgagctaggtcccaattcttcctcagcctctgctcctccaccctataatctttttatcacctcccctcctcacacctggtcccgcttacagtttcgttccgtgaccagccctcccccacctgcccagcaatttcctcttaaaaaggtggctggagctaaaggcatagtcaaggttaatgctcctttttctttatctgacctctcccaaatcagttagcatttaggctctttttcatcaaatatgaaaaacccagcccagttcatggctcgtttggcagcaaccctgagatgctttacagccctagaccctaaaagatcaaaaggccgtcttattctcaatatacattttattacccaatctgcccccgacattaaataaaactccaaaaattaaattccggccctcaaaccccacaacaggacttaattaacctcgccttcaagatgtacaataatagagtagaggcagccaagtagcaacatatttctgagttgcaattccttgcctccactgtgagacaaaccccagccacatctccagcacacgaacttccaaacgcctaaaccgcagtggccaggcattcctccaggcctgccttccccagaagcttgctacaagtgccagaaatctggccaccaggccaaggaatgcccgcaacccaggattcctcccaagcctcgtcccatctgggcgggaccccactggaaatcagactgtccaactcacctggcagccactcccagagcccctggaactctggcccaaggctctctgactgactccttcccagatcttctcggcttagcggctgaagactgacactgcccaatcgcctcagaagcccctagaccatcacggacgccgagctttaggtaactctcacagtggagggcaagtccatccccttcttaatcaatacggaggctacccactccacattaccttcttttcaagggcctgtttcccttgcctccgtaactgttgtgggtattgacagccaggcttctaaacctcttaaaactctccaactctggtgccaacttagacaatactcttttaagcactcctttttagttatccccacctgcccagttcccttattaggctgagacactttaactaaattatctgcttccctgactattcctggactacagccacatctcattgccacccttcttcccaatccaaagcctcctttatgtcctcctcttgcatccccccaccttaacccacaagtataggatacctctactccctccttggtgaccgatcatgcaccccttaccatctcattaaaacctaatcacccttaccccactcaatgccaatatcccatcccacagcacgctttaaaaggattaaagcctgttatcactcgcctgctacagcatggccttttaaagcctataaactctccttacaattcccccattttacctgtcctagaaccaaacaagccttacaggttagttcaggatctgtgccttatcaaccaaactgttttgcctatgcaccccgtggtgccaaacccatatactctcatatcctcaatacctccctccacaatccattattctgttctagaactcaaacatgctttctttactattcctttgcacccttcatcccagcctctctttgctttcacttggactgaccctgacacccatcaggctcagcaaattacctaggctgtactgctgcaaagcttcacagacagcccccattacttcagtcaagcccaaatttcttcctcatctgttacctatctcagcataattctcgtaaaaacacatgtgctctccctgctgattgtgtccgaataatctcccaaacctcaatcccttccacaaaacaacaacttctttccttcctaggcatggttactgcggtcagaattcttacacaagagccaggaccgcaccctgcagcgtttctgtccaaacaacttgaccttactgttttagcctagccctcatgtctgcatgcagtggctgccactgctttaatacttttagaggccctaaaaatcacaaactatgctcaactcactctctacagttcttataacttccaatatctattttcttcctcatacctgacgcatatactttctgcttcccggctccttcagctatattcactcttcgttgagtcttccacaattaccattgttcctggcatggacttcaatctggcctcccacattattctggataccacacctgaccctcatgactgtatctctctgatccacctgacattcaccccatttccccatatttccttatttcctgttcctcaccctgaacacatttagtttattgatggcagttccaccaggcctaatcaccactcaccagcaaaggcaggctatgctatattatcttccacatctatcattgaggccactgctctgcccacctccactacctctcagcaagccgaactagttgccttaactgaagccctcactcttgcaaaaacactacgtgtcaatatttatactgactgtaaatatgtctttcatattttgcaccaacatgctgttacataggctgaaagaggtttcctcactatgcaaaggtcctccattattaatgcctctttaataaaaactctgctcaaggccactttacttccaaaggaagctggagtcattcactacaaaggccatcaaaaggcgtcagatcccattgctctaagcaacgcttatgctgataaggtggctagacaagcagctagctttccaaattctgtccctcacagccagtttttctccttcacatcggtcactctcacctactcccccgctgaaactgccacctatcaatctcttcccatacaagtgaaatagttcttagaccaaggaaaatatctccttccagcctcacaggcccattctattctgtcgtcatttcataacctcttccatgtaggttacaagccactagcccgtctcgtagaaccgctcatttcctttccatcctagaaatatatcctcaaagaaatcacttatcagtgttccatgtgctattctactacccctccctttcctgcacatcaggctcagggatttgcccctgccccggactggcaaattgactttactcacatgccccaagtcagaaaactaatacctcttggtctgggtaaacactttcactggataggtagaggcctttcctacagggtctgagaaggccaccacggtcatttcttcccttctgtcagacataattcctcagtttggccttcccacctctatacagtctgatagtagactggcctttattagtcaaatcagccaagcattttttcaggctcttggtattcagtgaaacctttatatcccttaaagtcctcagtcttcaggaaaggtagaacagacaaatggtcttttaaaaacacacctcaccaagctcagccaccaacttaaaaaggactggacaatacttttaccacttccccttcccagaagtcagacctgttctcggaatactacagggtacagcctatttgagctcctgtatggacgctcctttttattaggccccagtttcattccagacaccagaccaaattggaccgtgccccaaaaaacttgtcatccctactatcttgtctagtcatactcctattcactgttctcaactactcatacttgccctgctcttgtttacactgccagtttacactgtttctccaagccatcacagctgatatctcctggtgctatccccaaactgccactcttaactcttaaagtaaataaataatctttgctggcaggactatgctgaatctccttaggcactctctaattaaatgtcctaggtcctccccaattcttagacctttaatacctgttattctccttctcttattccgtttttcaattcatacaaaaccgtatccaggccatcaccaataattctaaatgacaaatgtttaccacaaaatcttccttcagcttattctctcccactctaggttcccatgccacccctatcccgctcgaagcagccctgagaaacatcgcccattatctctccatatcacccccaaaaatttttgccgtcccaacaccttaccactatttcattttatttttcttattaacataagaagacaggaatgtcaggcctctgagcccaagctaagtcatcatatcccctgtgacctgcatgtacacatccagatggccagttcttgccttagctgatgacattccaccacaaaagaagtgaaaatggcctgttcctgccttaactgatgacattatcttgtgaaattccttctcctggctcatcctggctcaaaagctcccctgctgagcaccttgtgacccccattcctgccccccatagaacaacccccctttttcctttacctacccaaatcctataaaacagctgcaccccatctccctttgctgactctcttttcggacttagcccacctgtacccaggtgattaaaaagctttattgttcacacacac

SEQ ID NO: 115 - DNA, 63 bp, Homo sapiens
aaggccgactcatgcattttattacccagtcagctcccgacattagaaaaaaacttcaaaaat

SEQ ID NO: 116 - DNA, 5087 bp, Homo sapiens
cttcccccttagcctgtgttcttaaaaacctaaaaccccttcaactaacacctgacctaaaacctaaatgtcttattttcttctgtaataccacttggccccaatacaaactcgacaatagttccaagtggccagagaaatggcactttcgatttgtcttcttacaaaacctagataatttttgtcaaaaattgcgcaaatggtctgaggtgccttacatccatgcattttttacacttcgctccctccctagtctctgctcccagtgcgactcatcccagactttccttctttctctcccatctgctcctttcagtctctgctccaagctcagagtcctctgaatcctccttttccactgaccactctgacctctctccttctcccctggccgcaccttgccaggctgaatcaggtcccaattcttcggcagcctctgctcccccactctataacccttccattacctcccctcctcacacctggtctggcttacagtttcgtttagcaattagctctcccctacctgcccaacaatttcctcttacagaggtggctggagctgaaggcatagtcagggtacgtgtccccttttctctatcagacctttcccaaatcagccagcgtttagggtctttctcatcagactccactaaacatatacaggaattccaatatctaactcagtcctacaatctaacctggagtgacttaaatggagtcactccatttaaatggagaggtcgtcctgacctctaccctctcctcagatgaacaagaaagagtttactttctagcccagtcctacgcagatacccaccggcttcatgagccaggcttccaagagggcaccagggcagttccccgagaggattcccattggcaataccagacggactccccaggtatagctaggcaagattacacagtctcctgcctagtcaagtggctcaaaaaggcagcatacaaagttgttaattatgacaggctaaaggaaactacccacggtaaagatgaaaacccagcccagttcatggcccacttagcagctacccttagacactttacagccctagacccagaggggccagaaggccaccttatccttaatatgcattttatcacccaatccactcctgacattaggaaaaaattccaaaagttggattctggcccttaaaccccacaacaggatttaaacaatctcaccttcaaggtgttcaataacagagaagaagccaccaagcagcagcgtatctctaaattacagctacttgccttcactgtgagacaacccacaaccatgtctccagcatacaaaaccttcagaacatccaagccacagctcccatgggctccatcaaaacctcctcatggaccttgcttcaaatgccaaaagcctggccactgggcctcagaatgcctgcagcccgggattccttctaagctgtgccctatctgtgcgggaccccactggaagtcagattgtccaattcacatcgccgctgctcctaaagctcctggagctcaaacccaatgttccttggccaactccttcccagatcttggcttagcggctgaagactgacactgcccgatcgccttggaagacccctggaccatcatggatgccgagcttcgggtaactcttacagtggagggtaagtccattccctgtttaatcaatacgggggctacccactccacattaccttcttttcaagggcctgttttccttgcctccataactgttgtgggtattgacagccaggcttcaagaccccttaaaactccccaactctggtgccaacttggacaacattcttttatgcactcttttttagttctccccacctgcccagttcccttattaggccgagacattttaactaaattatctgtttccctgactattcctggactacagccacacctcattgctgcccttttacccgattcaaggcctcctttgaatcctcctctcgtgtctccctccctaccttaatccaaaagtatgggatacctctactccctccttggcgaccaatcaggcaccccttaccatcccattaaaacctaatcacccttaccccgctcaacgccagtaccccatcccacaacaggctttaagaggactaaagcctgttatcactcacctgttacagcatggccttttaaagctcacaaattctccttacaattctcctatcctacctgtccagaaaccagacaaatcttacaggttggttcaggatcttcgctttattaaccaaattgtcttacctatccagcctgtggtgccaaacccatacactctcctatcctccatacctccctccacaactcattattctgtcctcgacctcaaagatgctttcttcactattcctttgcacccctcattccaacctcttttcactttcacatggattgaccctgacagccaccaatctcagcaacccacctggactgtactgccaaggcttcagagacagcccccattactttagtcaagctctttctcatgatctactttctttccatccgtttctcaccttattcaatatatggacgaccttctcctctgcagcccctcttacgaatcttcccaacaggacatcctcctgctccttcaacatctgttctcaaagaagtatcgcgtatccccctctaaagcccagatttcttccccatccgttaccgatcttggcatagtccttcatcaaaacacaagtgctctccctgctgtgtccagctaatctccgaaaccccaaccccttctacaaagcaacaactcctttccttcctaggcgtggttgcacactttcgcctttggataccaggttttgccatcctaactaaaccactatataaactcacaaagggaaacctgactgaccccacagaccctaagtcctttccccattcttctttttgttccttaaagacagccctagaaacagctcccacattagcactccctaattcatcccaatccttcttcttacatatggctgaaaaacaaggctgtgcggtcggagttctcttacacaggaatcaggcccatgacctgtagtcttcctatccaaataacttaacctcacagttctaggctggccctcatgtctacgtgcagtggcagccaccacttcaatacttctagaggccctcaagatcacaaaccattccccacttactctctacaactctcataactttcaaaatctatttttctcctcacacttgaagcatatactttctgcccgactccttcaaccgtactcactattcattgaaactcctacaattaccattattcctggcacagacttcaacccggcctctcaccttatacctagcaccaaacctgaacctcgtgactgtatctctctaatccatatggcattctccccatttccccatatttccctctttcctgttcctaatccagactgcgcttggtttactgatggtagttcttcaaggcccaatcgttagtcatcggcaagggcaggctatgctgtagtgtcttccacatctgtcactgaagcttcctgccctgcccgcttccactacctctcaacgtgccaaacttattgctttaacccgggctctcacccttgcaaagggactacatgtcaatatctacactaattccaagtatgctttccacatcctacatcaccatgctgttatatgggcagaaagaggttttctcaccacacaagggtcctccatcatcaacgcttccttaataagaatcctccttaaggctgctctactgcccaaggaagccggagtcattcaccgcaaggggcatcaaaggtcaccagatcccactgcttgaggcaacgcttatgctgacaatgcagcaaaagtagcagctagtattctcacatctgtccctcacgaccagtttttttccttctcatttatcactcccacctattctcccactgaaactattacttatcaatcccttcctactcaaggcaaatggttcttggatcaaggaaaattcctccttcctgcctcacaggctcattctatcttatcattctttcatgacctttttcatgtgggttacaagccaatggcccatctcttagaacctctcatttcttttccatcatggaaatccatcctcaaggaaattatttctcagggttccatctgctactctaccacccctcagggatatctcaggccccctccctttccgacacatcaagctcgaggatctgcccccacacaagactggcagattgactttacccatatgccccgactcaaaaaactaagataccttttggtctgggtagatacattcactggatgggtagaggcccacagggtctgagaaggccaccgcagtcatttcttcctgtcagacataattcctcagtttgaccttcccacctctatacagtccgataacggaccggccttcattagtcaggtccctcaagcagtctcccaggccttcggcatccagtggaaccttcattccccctaccatcctaaatcttcaggaatggtagaaagaactaatggtcttttaaaaacacctcaccaaactcagcctccaaattaaaaaagactggactgtacttttaccatttgccctccttagaattagagcctgtcctcaagaagctacagggtatagtccatttgaacttttatatggatgtaccttcttgttgggcctcaatctcgtgccagacaccagccctctaggcgactatcttccagtcctccagcaggctagacaggaaattcgccaggctgctaatcttctcttgtctactccagattcccagccatatgaagacaccctagctggatgatcagttcttgttaagaatctgatccctcaaactctataatcttgatggaccagaccctacttagtcatctacagtaccctaactgccgtccgcctgcaggaccctccccattgggttcaccattctggaataaagctgtgtccattggacagccagcctgatccctcctcttcctcttggaagtcacaagtactctcccctacttcccttaaactcactcgcatttctgaagaacag

SEQ ID NO: 117 - DNA, 5515 bp, Homo sapiens
gtcaggcctctgagcccaagcgaagccatcatatcccgtgtgacctgcacgtatacatccagatggcctgaagcaactgaagatccacaaaagaagtgaaaatagccttaactgatgacattccaccattgtgatttgttcctgccacaccctaactgatacaatatattctcccctgcccttaagaaggtaatttgtggccaggcgtggtggctcaagcctgtaatcccagcactttgggaggccaaggcaggcagatcccaaggtcaggagatcgagaccatcctggctaacatggtgaaaccccgtctctactaaaaatacaaaaaattagccgggcgtggtggcgggcgcctgtaatcccagctactcagaaggctgaggcaggagaatggcgtgaacctggggggccgaggtggcagtgagccgagatcacgttactgcactccagcctgggcgacagagcaagactctgtctcaaaaaaaaaaaaaaaaaaaaaaaaaaagaaggtactttgtaatattctcccctgctcttaagaatgtactttgtatgcctatccctataagaactaatgataatcccaccaccctttgctaactcttttttcagactcagcccacctgcactgaggtgaaataaacagctttattgctcacacaaagcctgttggtggactctcttcacattgatgcgcgtgacattttgtgctgtgacttggattgggggcccttccttgggagatcaatcccctgtcctcctgctctttgctccaggagaaagatccaccacgaccttgggtcttcggaccaaccagcccaaggaacatctcaccaattttaaatcgggtaagcggcctctttttactctcttctccaacctctctcactatccctcaacctctttctccattcagtcttggcaccatccttcaatctctcccttctcttaatttcagttcctttccttttctggtagagacagaggagacacattctatccgtgaacccaaaactccagcaccagtcatggcctcgggaagacagtcttcccttggtgtttaatcactgtgggaatgcctgcttgattattcacccatgtttcagaggtgtctgatcaccgctgggaagcctgccttgatcgttcacccttagtggcaagcaccactttcctggggggcaacaccccccaccccttctctccatgtctccactctctcttttctctgggcttgcctccttcactatgggcaaccttctaccctccattcctccttcttctcccttagcctggcaagaacttaaaacctcttcaactcacacctgacctaaaacctaaaccccttattttcttctgcaatgccgcttaaccccaacacaaactcgacagtggttccaaatagccagaaaatggcactttcgatttttccatcctacaagatctagataattcttgtcataaaatgggcaaatggtctgagatgcctgatgtccaggcattcttttacacatcggtccctccctagtctctgtttccaatgctactcatcccaaatcctccttctttccctcccacctgtcccctcagtcccaaccccaagtgtcactgagtcttttcaatcttccttttctactgacccatctgacctctcccctcctccccaaactgctcctcctcaggtctttccctgccaggctgaatcaggctccaattcttcctcagcctccgctcccccatcctataatccttctgtcacctaccctcctcacacccagtccagcttacagttttgttctgcaactagccctccccgacctgcccaacaatttcctcttaaagaggtggctggagctaaaggcatagtcaaggttaatgctcctttttctttatctgacctctcccaaatcagttagcgtttaggctctttttcctcaaatataaaaacccagcccagttcatggctcctttggcagcaaccctgagacgctttacagccctagaccctgaagggccaggaagccgtcttattctcaatatgcattttattacccaatccgctcccgacgttagataaagctccaaaaattagattccggccctcaaaccccacaacaggacttaattaacctcaccttcaaggtatgcaataatagagtagaggcagccaagtagcaaaatatttctgagttgcaattccttgcctccactgtgagagaaaccccagccacatctccagcacacaagaacttcaaaatgcctaagccgtagatgcctaagctgcagcggtcaagccttcctacaggacctcctccatcaggaccttgcttcaagtgccagaaatctggccaccgggccaaggaatgccagcagcccaggattcctcccaagctgtgtccaatctgtgcagggatccactggaaatcaaaccacccagcttgcccggcagccactcttagagcccctaaagctctggcctaaggctctctgactgacgccttcccagatcttcttggcttcgcagctgaagactgacactgctcaatcacctcagaagcctcctggaccatcacagacgctttgggtaactcttaaagtggagggtaagtcagtccccttcttagtcaatatggaggctacacactccacattgccttcttttcaagggcctgtttcccttgcctccataactgttgtgggtattgacggccaggcttcaaaatcccttaaaattcccccactctggtgccaacttggacaacattcttttatgcactccttttgttatccccacctgcccagttccttattaggccaagacactttaaattatctgcttccctgactattcctgggctacagccacacctcattgccgcccttttccccagttcaaagcctccttcacatcctccccttgtacctccccaccttaatccacaggtataggacacctctactccctcctcggcgaccgatcatgcaccccttaccatcccattaaaacctaatcaccctaccttgctcaatgccaatatcccatcccacagcacgctttaaaaggattaaagcctgttatcactcacctgttacagcatggccttttaaagcctataaactctccttacaattcccctattttacctgtccaaaaatcagacaagtcttacaagttagttcaggatctgtgccttatcaaccaaattgttttgcctatccaccccgtggtgacgaactcatatactctcctcctcaatgcctccctccacaacccctccacaagccattattctgttctggatctcaaacgtgctttctttactattcctttgcgtcccatcccagcctctcttcgctttcacttggactgtccctgacactcatcaggctcagcaagtttcctgggctgtactgcctcaaggcttcacggacagcccccattacttcagtcaagcccaaattccttcctcatccattacctatctcggcataattcttcatgaaaacacacatgctctccctgctaatggtgtccggttaaatctatcctcaaggaaatcacttctcagtgttccatctgctattctcctactcctcagggatcgttcaggccccctccccttccctacacgtcaagctcagggatttgcccccacctaggactggcaaattgactttgctcacatgccccgagtcaggaaactaaaatacctcttggtctgggtagacgctttcaccggatgggtagaggcctttcccacagggtctgagaaggccaccacagtcatttcttcccttctgtcagacataattcctcggtttggccttcccatcactatacagtccgataccggaccggcctttattagttaaatcaccaagcagtttctcaggctcttggtattcagtagtaaaatcttcataccccttaccgtcctcaatcttcaggaaaggtaaaacggactaatagtcttttaaagacatacctcaccaagctcagcctccagcttcaaaaggactggacagtacttttacctctcacccttctcagaattaaagcctgtcctcagggtgctagtaaagcccatttaagctcctgtatggacagtcctttttattagagcccagtctcattccagacaccatcccaacttgaactgcaccccaaaaacttgtcatccctgctatcttctgtctagtcatactcatattcattattttcaactacttgtaaataccctgcccttgtttacactgccagtttacacttttcctccaaaccatcataactgatatctcctggttttacctcaaaccggcaccattaagtctctctcaaagtggatagatcatctttgctgacagggtgcactccagtactttcaccctgatgaagtcctattctttacttttatactcactcttattctcgttcccgttcttatgccaccctctacctctccccagctatctccaccacactatcaatctcactcactctctcctagccatttctaacccttctttaacaaacaatttctggctttgcatttctctttcctccaaaattgtggaggcctcgacttactcactgctaaaaaaaaaattaaaaaaagactccatatatttttaaataaagtgttttttttgtttttgttttacctaaatcaatctggcctggtatacaacataaaaaaactcaaggatagagcccaaaaactcgccaaccaagcaaataattatgctgaacccccttgggcactctctaattggatgtcctgggtcctcccaattcttagtcctttaatacctgtttttctcttcctcttattcggaccttgtgtcttctgtttagtttctcaattcataaaaaaccgcttccaggccatcaccaatcattctatacgacaaatgctccttctaacaaccccacaacatcaccccttaccccaaaatctttcttcagtttaatctctcccattctggattcccatgctgcccctaatcccgctcgaagcagccctgagaaacatcttccattatctctccataccacccccaaaaattttcgccgccccaacacttcaccactattttgttttgtttttcttattaatataagaagacaggaatgtcaggcctctgagcccaagcgaagccatcatatcccctgtgccctccacatatacatccagatggcctgaagcaactgaagatccacaaaggaagtgaaaatagcttaactgatgacattccaccattgtgatttgttcctgccccaccccaactgatatgatatgttctcccccgcccttaagaaggtactttgtaatattctcccccgcccttaagaaggtactttgtacacctatcccaaacctacaagaactaatgataatcccaccatcctttgctgactcctttttcggactcagcccgcctgcacgcaggtgaaataaacgccttgttgctcacacaaagcctgttggtggactctcttcacacggacacgcatga

SEQ ID NO: 118 - DNA, 4311 bp, Homo sapiens
gagagacaggactagctggatttcctaggccgactaagaattcctaaccctagctggggaaggtgactgtatccacctttaaatatggggcttgtaactcagctcacacctgaccaatcaggtaacagagagctcactaaaatacccgttaagctaaaagcaggaggtaaagaaatagtcatctatcgcctgagagcacagggggagggacaactatcaggatataaacctaggtattcgaactggcagtggcaaccccctttggatcccctcccattgtatgggagctttgttttcactctattaaatcttgcaactgcacactcttctggtccatgtttgttagggctcaagctgagctttcactcgccgtccaccactgctgaacgtcgccgtcgcagacccgccattgactttcaccgctctggatccggcaaggtgtctgctgcgcttctgatgcagcaaggcgcccattgccgctcctgatcaggctagaggcttgccattgtttctgcgcggctaagtgcatgcattcatcctagtagagctgaacactagtcgctgggttccacggttctgttctgtgacccacggcttctaacagagctataacactcccctcgtggcccaaggttccattccttggaatccttgaggccaagaaccccaggtcagagagcaaaaggcttgctgctatcttgggagcagcctgccatcatcttgagagctctaagaacaaagacccaccagtaacatctggtggcctgtacagggattctccaaagccctgagtaatactggaccactttgacttgctattctgtcctatccttccttagaatcagaggaaaatactgggcagctgttgaccatttaaaaatgattagcatggctgctggacttaagactcaggtgtgaggctttctgggaaaaggcgaacagcccccatctgagttgggagcattggtctgcctggaaccagcttccgcttttacaattttcctggggaagctgagggccgactagaagcagaaaactgtcatcctgaattcccggcattggccagtcgagatcatggtgcagccagaagtctctactccacagtcgcccatgcaggcacccctacctctccttttgacccatacctcctgggtcccaaccaccactttcttgaaagtgtagccccaaaattctccttacctctgaatctacttcctccagtccctgcctcctaggtactaatgcttcagactttcactccctctcccaggtattagagcaagttgtatctccaaagggatctagagaagctctacactgcatccttaggcacctaggctatgaacccagggagtcttgcccctggtgtctctcccaatttaggtatacagccctcgacgtgggtagttaggtgggacccgttcctcaccacccttgccagggccccaaatttgtaaatggctaggaggattgctctcccattgtgtaagatgctctcctcccccaatttctacccagcttacccccacctgcaatgcaatctccaagcctcagctccttggccagggccttagaactggtaacccagtactttaacaactggaactgggtctacaacaacataatagatcaggatgaaagcaaattgaataaattaaagggaggagcatattcctatagtggcaaatgggggcaacgagcaaatgtccttctgctgtgttcccaaaatccatctaccaaagggaagggagaaagagaggggaaaaagagagaaagaggtagagaaacaaagggagtcagagagagacagaaagtcagagagagaaagaaagagaagtagtaaagaaaaaagtgtaccctattcctttaaaagccagggtaaatttaaaacctataattgataattgaagatcctctccgtgaccctgtaacactccaataccaccttgttatcagtgtaaacaagggtgtagccaaaagcgctgaggccactgacaacccgtagccttcctatcaaaaatccttaacccaataacccacagatggctcaaatgcattcaatctgtagcagcaactgctttgctagcagaagaaagtagaagaataactttagaggaaacctcattatgagcatacctcaccagttcagaaataccctaagtaaaaaaggcaaaaaggtagcttactgactcaaaaatcttaaagtatcgggctgttctttagaaaaagatgatttaacattaaccactgaaaattcccttaacccagcagatttcctaacgggatttaaatcttattactatacaaagttctaaccagacctaggaggaacttccttgaggacaggacaataaatagttcctcccgggtgattgagggaaaaaaacacaatgggtattcagtaattgataggaaaactcttgtagaagcagagttagaaaaattgtctaataattggtctgctcaaacgtgcgagctgtttgcactcagccaagccttaaagtacttacagaaccaggaaggaaccatctataccaattctaagttaatttagactaaacaaagtcttagtaatagcaaaggacctaaaagcccaaggccatgcaatagcccctgcagtactccaattttaggagtgcagaagcccaacggacagtggaggttagtgcaagatctcaggattatcaatgaggccgttgtccctctatacccagctgtacctaacccttatactctactttcccaaataccagaggaagcagaatggtttacagtcctggaccttaaggatgcctttttctgtatccctgtacatcctgactctcaattcttgtttgcctttgatgatccttcgaaccaacatctcaactcacctggactgttttaccccaagggttcagggctagcccccatctatttggccaggcattagcccaagacttgagtcagttctcatacttggacactcttgtcctttggtatgtggatgatttagttttagccacctgttcagaaaccttgtgccattaagccacccaaacactcttaaagttcctcgccacctgtggctacaaggtttccaaaccaaaggcttacctctactcacagcaggttaaatacttagggctaaaattatccaaaggcacctgggccctcactgaggaacacatccagcttatactggcttatgctcatcccaaaaccctactaactgttggatgtgcctcaccctgcacttcaggccatacatttcaatccctgtatctttaacctccttgttaagtttgtctcttccagaattgatgctgtaaaactacaaatcgttctttaaatggagccccagatgcagtccatgactaagatctaccgtggacccctggaccggcctgctagcccatgctctgatgttgatgacatcaaaggctcccctaccgaggaaatctcaactgcacaacccctactatgccccagttcagcaggaagcagttagagtggtcgtcagccaacctccccaacagcacttgggttttcctgttgagaggggggactgagagacaggactagctggatttcctaggccgactaagaattcctaagcctagctggggaaggtgacctcacccacctttaaacatggggcttgtaactcagctcacacctgaccagtcaggtagtaaagagagctcactaaaatgcccattaggctaaaagcaggaggtaaagaaatagtcaatcatctatcacctgagagcacccggggagggacagtgatcaggatataaacccaggcattcgaaccagcagtggcaagcacctttgggtcccctcccgttgtatgggagctttggtttcactctgttaaatcttggaaccacacactcttctggtccacgtttgttactgttcgagctgagcttttgctcaccatccaccactgctgaatgccaccttctcagactggccattgactttcacccctctggatctggcaccgtgtccgctgcgcttctgatccggggaggtgcccattgccgctcccgatcaggtagaggctcgccattgtttctgtgcggctaagtgcgcgggtttgtcctactcgagctgaacacttgtctctgggttccacagttctcttccgggacccacagcttctaatggagttgtaacactcaccgcatggcccaaggttccattccttggaatccgtgaggccaagaaccccccaggtcagagagcaaaaggcttgctgccatcttgggagcggcccaccaccatcttgggagttctaagaacaaacacctgccagtaaca

SEQ ID NO: 119 - DNA, 524 bp, Homo sapiens
taaaagaggaaggcctctttgcagttgagataacaggaaggcatctgtctcctgctcgtccctgtgcaatggaatgtctaggtgtaaaacccgattatattttccatctactgagataggagaaaaccaccttaaggctggaggtgagatgctggcggcaatactgctctttaatgcgtcgagatgtttatgtctgtgcacatcaaaacacagcacctttttcttaaccttgtttatgacacagagacatttgttcacgtgttttcctgctgaccttatccccactattaccctattgtcctgccacatccccctctccgagatggtggagataatgatcaataaatactgagggagctcagagaccggtgccagcgcacagcgcgggtcttccgtatgctgagcgccggtcccctgggcccacttttctttctctatactttgtctctgtgtctctttcttttctcagtctctcgtcccacccaacgagaaagacccacaggtgtggaggggcaggccacccc

SEQ ID NO: 120 - DNA, 664 bp, Homo sapiens
agtaggtagttaggcagacataagcagggcaggagaggccccccttccccaccagaaatgtcaggcaaccatcaggtgatggtcaggcagttgttaaactgtctctctaaaataatagttggtttcagcaagaaccagggaaaggcagtctcccaatagacagaaagcacctgaaactggttatcatcagcttcctgataagatctcaggagttgggtgagtgggctcaagcatccgcactaagaggaaaatggcggtttaactgctatatggtttaactgctatatgaccttcctctgggaatgctcaactggtaaggaaaaaaatgcctcaagtgagcatgcgtacaacttcagcagacacactgcaaatgtggcctctcccaagtgctggcaggccactgcacatgcagaatgccagcatataaaaccccaactcaaagatcaaaacagcacacttgaatctctcaagttacctgctcagccctcttccaagtgtgtgtcacttccttttgttcctgctctaaaactttttaataaactttccctcttgctctaaaacttgcctctatctctctctctaccttatgccccctcagttgaattctttcttctgaagaggcaagaattgaggctgctgcagacctgtgcagattcaccactgc

SEQ ID NO: 121 - DNA, 6004 bp, Homo sapiens
gtcaggcctccgagcccaagccaagccatcgcatcccctgtgacttgcacgtatatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaatggccccatccttatctcccttcgctgactctctcttcggactcagcccgcctgcacccaggtgaaataaacagccatgttgctcacacaaagcctgtttggtggtctcttcacatggacgcgcatgaaatttggtgctgtgactcggatgggggacctcccttgggagatcaatcccctgtactcctgttctttgctccgtgagaaagatccacctatgaccttaggtcttcagaccgaccagcccaagaaacatctcaccaatttcaaatctggtaagcggcctctttttaccctcttctccaacctccctcactatccctcaacctctttctcctttcaatcttggcgccacacttcaatctctcccttctcttaatttcaattcctttcattttctgatagagacaaaggagacatgttttatccatggacccaaaactccggcgccggtcacggactgggaagacagccttcccttggtgtttaatcattgcagggacgcctctctattcacccacgtttcaaaggtgtcagaccacgcatggacgcctgccttggtccttcacccttagcggcaagtcccgcttttctggggaaggggcaagtaccccaactccttctctccttgtctctaccccttctctgctttccgaggaaagggcgagtatcccaaccccttctctccttgtctctactccttctctgcttttctgggagaggggcaagtacccctcaaccccttctccttcactcttagtggcaagtcccgcttttctagaggagggacaagtgccccaacctcgtatctctgtgccccaatcccttatttccgtgccccaacctcttatatctctgcaccccaatcccttatttcagtgtcccaaccccttatttccgtgccccgaccccttatttctgtgcccctaccccttatttccgtgcccctaccccctatttctgtgcccctaccccttatttccgtgccccttccccttatttccatgccctgaccccttatttctgcgccccatcccttatttctgcatcccaacctcttatctctgtgccccgacctcttatctctgcgccccaaccccttttcccacttttctggaaggtaagaacccccgaaccccttccctctgtttttctctcttttctctaggcttgcttccttcactataggcaaccttccaccctccattcctccttctgctcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttctatcctgcaagatctaaataattcttgtcataaaataggcaaacggtctgaggtgcctgacgtccaggcattcttttacacatcagccccttcctagtctctgtgcccagtgcaacttgtcccaaatcttccttctttccctcccgcctgtcccctcagtaccaaccccaagcatcactgagtctctctaatcttccttttctacagacccatctgacctctcccttcctccccaggctgctcctcgccaggccgagctaggtcccaattcttcctcagcctccgctcctccaccctataatctttttatcacctcccctcctcacacctggtccggcttacagtttccttccgtgactagccctcccccacctgcccagcaatttactcttaaaaaggtggctggagccaaaggcatagtcaaggttaatgttccttttctttatcccaaatcagaagcatttaggctctttttcatcaaatataaaaatccagcccagttcatggctcctttggcagcaaccctgagacgctttacagccctagaccctaaaaggtcaaaaggccgtcttattctcactatacattttattacccaatctgctcctgacattaaataaaactccaaaaattggaatctggccctcaaaccccacaacaggacttaattaacctcaaccttcaaggtgtacaataacagaaaaaagttgcaattccttgccttcactgtgagacaaaccccagccacatctccagcacacaagaacttccaaacacctgaaccacagcggccaggcattcctccagaacctcctcccacaggagcttgctgcatgtgccaaaaatctggccactgggccaaggaatgcccacagcccgggattcctcctaagctgcgtcccatctgtgtaagaccccactgaaaatcggacggttcaactcacctggcagccactcccagagcccctggaactctggcccaaggctctctgactgactccttcccagatcttctcggcttagcggctgaagattgacactgcccgatcgcctcggaagccccctagaccatcacggacgctgagcttcgggtaattctcacagtggaaggtaagcctgtccccttcttaatcaatacagaggctacccactccacattaccttcttttcaagggcctgtttcccttgcctccataactgttgtgggtattgacagccaggcttctaaacctcttaaaactccccgactctggtgccaacttagacaatactcttttaagcactcctttttagttatccccacctgcccagttcccttattaggctgagacactttaactaaattatctgcttccctgactattcctggactacagctatatctcattgccacccttcttcccaatccaaagcctcctttgcatcctcctcttgtatccccccaccttaacccacaagtataagatacctctactccctccttggcgaccgatcatgcaccccttaccatctcattaaaacctaatcacccttaccccactcaacgccaatatcccatcccgcagcatgctttaaaaagattaaagcctcttatcactcgcctgctacagcatggccttttaaagcctataaactctccttacaattccccgattttacctgtcctaaaaccagataagccttacaagttagttcaggatctgcgccttagcaaccaaattgttttgcctatccaccctgtggtgcccaacccgtacactcttttgtcctcaataccttcctccacaactcactattccgtgcttgatcttaaagatgcttttttcactattcccctgcaccccttgtcccagcctctctttgctttcacttagactgaccctgacacccatcgagctcagcaaattacctaggctattcggccgcaaagcttcacagacagcccccattacttcaatcaagcccaaatttcttcctcatctgttacctatcttggcataattctcaaaaaaacacacgtgctctccctgccaattgtgtccaactgatctctcaaaccccagcaccttctacaaaacaacaactcctttctttcctaggcatggttagcgcggtcagaattcttacacaagagccaggaccacaccctgtagcctttctgtccaaacttgaccttactgttttagcctagacctcaggtctgtgtgcagcggctgccgctgctttaatacttttagaggccctcaaaatcacaaactatgctcaactcactctctatagttctcataacttccaaaatctattttcttcctcatacctgatgcatatactttctgctccgcagctccttcagctgtactcactctttgttgagtctcccacaattactgttgttcctggcccagacttcaatccggcctcccacattattcctgataccacacctgacccccatgactgtatctctctgatccacctgacattcaccccatttccccaagtttccttctttcctgttcctcaccctgatcacgcttgatttattgatggtggttccaccaggccgaatcgccacacaccagaaaaggcaggttatactatagtactagccactagcccgtctcttagaacctctcatttcctttccatcgtggaaatctatcctcaaagaaataacttatcagtgttccatctgctattctactactcctcagggattattcaggccccctcccttccctacacatcaagctcaaggatttgcccccacccaggactggcaaattagctttactcaacatgccctgagtcagataactaaaatacctcttagtctagatagatactttcactggataggtagaggcctttcctacagggtctgagaaggccactgcagtcatttcttccattctgtcagacataattcctcagtttagccttcccacctcaatacagtctgataacagacgagcctttattagtcaaatcagctaagcagtttttcaggctcttagtattcagtgaaacctttatatcccttacggtcctccatcttcaagaaaagtagaatggactaaaggtcttttaaaaacacacctcaccaagctcagccaccaacttaaaaaggactggacaatacctttaccactttcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctactatcttctgtctagtcatactcctattcaccgttctcaactactcatacatgccctgctcttgtttacactgccggtttacactgtttctccaagccatcacagctaatatctcctggtgctatccccaaactgccactcttaactcttgaagtaaataaataatctttgctggcaggaatatgctgaatctccttaggcactctctaatcagatatcctgagtcgtcccaattcttagaccttttatacctgtttttctccttctgttattccatttagtttctcaattcatcccaaaccgtatctaggccatcaccaatcattctataagacaaatgtttcttctaacatccccacaatatcaccccttaccacaagacctcccttcagcttaatctctcccactctaggttcccatgccgcccctaatcccgcttgaagcagccctgagaaacatctcccattctctctccataccaccccccaaaattttcgccgccccaacacttcaacactattttgttctatttttcttattaatataagaaggcaggaatgtcaggcctctgagcccaagccaagccatcccctgtgactggcacgtatatgtccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggttcatcctggctcaaaaagcacccccactgagcaccttgcgacccccactcctgcccgccagagaacaaaccccctttgactgtaattttcctttacctacccaaatcctataaaatggccccacccttatctcccttcgctgactctctttttggactcagcccgcctgcacccagatgaaataaacagccatgttgctcacacaaagcctgtttggtggtcccttcacacggacgcgcatgaaa

SEQ ID NO: 122 - DNA, 5918 bp, Homo sapiens
gtcaggcctctgagcccaagccatcatatcccctgtgacctgcatgtatgcatccaggtggcctgaagtaactgaagaatcacaaaagaagtgaaaatggcctgttcctgccttaactgatgacattaccttgtgaaattccttctcctagctcatcctggctcaaaagctcccccactgagcaccttgtgacccccgcccctgcctaccagagaacaacctcctttgactgtaatttcccactacctacccaaatcctataaaacggccccacccctatctccctttgctgactctcctttcggactcagcccacctgcacccaggtgaaataagcagccttgttgctcacacaaaacctgtttggtggtctcttcacagcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcgggtaagcggcccctctttactctcttctccaacctctctcactatccctcaacctctttctcctttcaatcttggtgccatctttcaatctctcccttctcttaatttcagttcctttccttttctggtagagacaaaggagacatgttttatccatggacccaaaactccggtgccagtcacggactcaggaagacagtcttcctttgatgtttaatcacgtggggatacctgcctgattattcacccacatttcatcagtgtctgatcaccgcagggacgcctgccttggtcattcacccacattcccttgctggcaagtcaattgcagggatgcctgctttggctgctcacccacattgcagcccagggctgctcacccaaccccttcccgccatgtctctaccctctcttctctccactttcctggggggcaagcacccccccaccccttctctccatgtctctaccctgtcttttctctggacttgcctccttcactataggcaaccttccaccctccattcctccttcttctcccttagcctgtgttctcaagaacttaaaacctcttcaactcacacctgacctaaaacctaaatgcattattttcttctgccatgccacttgaccccagtacaaactccacagtggttccaaatagccagcaaatggcacttttgatttttccatcctacaagatctaaataattcttgttgtaaaatgggcaaatggtctgaggtgcctgacgtccaggcattcttttacatatcggtccctccctagtctctgttctcaatgcaacttgtcccaaatcttgcttctttccctcccgccttgtcccctcagtcccaaccccaagcatcgctgagtctttccaatcttccttttctacagacccatctgacctctcccctcctccccaggctgctcctcaccaggccgagctaggtcccaatttttcctcagcctccggtcccccaccctataatccttttatcacctcccctccttacacctggtctggcttacagtttccagtttcgttctgtgactagccctccccaacctgcccagcaatttcctcttaaaaaggtggctgtagctaaaggcatagtgaaggttaatcctcctttttctttatccgatctctcccaaatcagttaatgtttaggctctttttcatcaaatataaaaacccagcctagttcgtggcccgtttggcagcaaccctgagatgctttacagccctagaccctgaaaagtcagaaggccatcttattctcaatatgcattttattttatcacccaatctgctcccgacattaaataaagctccaaaaattaaattctggccctcaagccccacaacaggacttagttaaccttgccttcaaggtgtacaataatagagtagaggcagccaagtagcaatgtatttctgagttgcaattctttgcctccactgtgagacaaaccccagccacatctccagcacacaagaaatccaaacacctggatgaggttctggatgaaccgcagctgccaggggttcatccagaacctccttccccaggagcttgctatgagtgctagaaatctggccactgggccaaggaattcctgcagcctgggattcctcctaagccatgtcccatctgtgcaggatcccactgaaaattggactgttcaatttacctggcagccactctcagagcccctggaactctggctcaaggctctcttactccttcccagatcttctcagcttagcggctgaagactgatgctgccagatgactttggaagccccctggaccatcacagatgcccagctttggataactcttacagtggagggtaagtccgtcctcttcttaatcaatacagaggctacccaactccacattaccttctttcaagggcctgtttcccttgactccataactgttgtgggtattgatggccaggtttcttttttttttttttttttttttttgagatggagtctggctctgtcgcccaggctggaatgcagtggtgcaatctcggctcgctgcaagctccacctccggggttcacgccattctcctgcctcagcctcccgagtagctgggactacaggcccccgccactacgcccagctaattttttatatttttagtagagacggggtttcaccgtgttagccaggatggtctcaatctcctgacctcgtgatccacccgcctcggcctcccaaagtgctgggattacaggcatgagccaccgtgcccggccgatggccaggtttctaaacctcttaaaactccccaactctggtgccaacttggacaatattcttttatgcactcctttttagttatcctcacctgcccagctcccttattaggtcgagacattttaactaaattatctgcttccctgactattcctaggccacagccacacctcattgctgcccttttccccagttcaaagcctccttcacatcctccccttgtatctccccacctcaatccacaggtatgggacacctctactccctccttggcaactgatcatgcaccccttaccatcccattgaaacctaatcacccttaccccactcaatgccaatatcccatcccacagcacgtgttaaaaggattaaagcctgttatcactcacctgttacagcacggccttttaaagcctgtaaactctccttacaatttccccattttacctgtcctaaaactggacaagccttacagtttagttcaggatctgagtcttatcaaccaaaaccaaattgttttgcctatccaccccgtggtgccaaacccatatactctcctatcctcaatacctccctctacaacccattattctgttctagataaacctagctgaccccatagatcctatatcctttccctactttcctttccattccttaaaaaacagctcccacactagctctccctaactcatcactcccttttcattacacacaaccgaagtgcagggctgtgtggttgaaattcttacacaagagccagaccgtgccctgtagcctttctgtccagacaacttgaccttactgttttaggctggccatcgtgtctgcatgcagcggctgccactgctttaatacttttagaggccctaaaaatcacaaactatgctcaattcactctctacagttctcataacttccaaaatcgattttcttcctcacacctgatgcatatactttctgcccccaccccactacctctcagcaagccaaactcattaccttaactcgagccctcactcttgcaaaaggactacgcgtcaatatttatactgactctaaatatgccttccatatactgcaccaccatgctgttatatgggttgaaagaaatttcctcactacacaagggtcctccatcattaatgcctctttaataaaaactcttctcaaagctgctctacttccaaaggaagctggagtcattcactgcaagggccatcaaaaggcatcagatcccctcactgaggacaattcttatgctgataaggtagctaaaaaaacagctagtgttccaacttctatccctcagggcagtttttctccttctcatctggccactcccacctactcccccactaaaacttccacctgtcaatctcttcccacacaaggcaaatggttctcagaccaagggaaatatctccttccagcctcacaggcccattctattctgtcatcatttcataacctcttccatgtaggttacaagccactagcccaccccttagaacctctcatttcctttccattgtggaaatctatcttcaaggaaatcacttctcagtgttccagctgctattctactactcctcagggattgttcaggccccctcccttccctacacatgaagctcgggcccccgtccagaactggcaaattgactttactcatatgccccgagtcaggaaactaaaatacctcttggtctgggtagacactttcactggatgggtggaggcctttcccacagggtatgagaaagccactgtggtcatttcttcccttctgtcagacataattcctcgtttggcttttccacctctatacagtccgataacggacaggcctttattagtcaaatcacccaagcagtttctcaggctcttggtgttcagtgaactaacggtctttttaaaacacacttcaccaagctcagccaccaacttaaaaaggactggatacttttaccactttcccttctcagaattcgggcttgtcctcaaaatgttacagggtacagcccatttgagctcctgtatagatgctccttttattaggccccagtctcattccagacatcagaccaacttggactgcaccccaaaaacttgtcatccctactgtcttctgtctagtcatactcctattcaccattatcaactactcataaatgccctgctcttctttacactgccggtttacactgtttctccaagccatcacagctgatatctcctggtgctatccccaaaccgccactcttaactcttaaagtaaataaataatctttgctggcagggctatgctgaacccccttgagcactctctaattggatgtcctaggtcctcccaattcttagtcatttaatacctgtttttctccttctcttatttggaccttgtgtcttctgtttagtttctcaattcataacaaaactgtatccaggccatcaccaatcattctatatgacaactgtttcttctcacaaccccacaatatcaccccttaccacaaaatcttccttcagcttaatctctcccactctaggttcccatgccacccctaatcccgctagaagcaaccctgagaaacatcatccattatctttccataccaccccccgaaaaatttttaccatcccaacactttaccactattttgttttatttttcttattaatataagaagacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggccccacccctatctccattcactgactctttttggactcagcccacctgcacccaggtgaaataaacagccttgttgctcacacagaacctgtttggtggtctcttcacacggcgagtgaaa

SEQ ID NO: 123 - DNA, 58 bp, Homo sapiens
tgcctgtatatgccggcagccccctagcccgctctttcactggatatctgtgtctgag

SEQ ID NO: 124 - DNA, 1384 bp, Homo sapiens
gtagggaaaagaaagagagatcagactgttactgtgtctatgtagaaagaagtagacataagagactccattttgttctgtaataagaaaaattcttctaccttgagatgctgttaatctgtaaccctacccccaaccctgtgctggcagaaacaagtgctgtgttgattcaaggtttaacggatttagggctaggtaggacgtgctttgttaaacaaatgcttgaaggcagcatgcttgttaaaagtcatcaccactccctaatctcaagtacacagggacacaaatcactgcaggaggccacaggaacctcttcctaggaaagccaggtattgtccaaggtttctccccatatgaaagtctgaaatatggcctcgtgggaagggaaagacctgaccatcccccaaccccacacctgtaaagggtctgtgctgaggaggattagtaaaagaggaaggcctctttgcagttgagataagaggaaggcatctgtctcctgctactccctaggcaatggaatatctgcttgtaaaacccaattgaatgttccatctactgagataggagaaaaccaccttcaggctggaggtgagatatgttgctggcaatactgctctttaatgcaccagatatgtttatgtatgtgcacatcaaagcacagcacattttctaaccttgtttatgacacagagacatttgttcacatgttttcctgctgaccatctccccactattacactattgtcctgccacaaccccctctctgagatggtagagataatgatcaataaatactgagggaacggagagacctgtgccagcgtgggtcctccctatgctgagcacttgtcccctgggcccacttttctttctctatactttgtctctgtgtctctttcttttctcagtctctcatcccacccaatgagaaatgcccacaggtgtggagcagctggccaccctttcatctggtgcccaacgtgggtgctttcctctagggtgaaggtacgctcaagcgtggtcactgaggacaagttgatgagagattcccgagtacgtctacagtcagccttgtggtaagctcgaaagaagccagggtaacaatggggcaaactaaagtaaatatgcctcttatctcagctctattaaaatttttgtaaaaagtgggggagttagtgtttctacaaaaaatcaaatcacgctatttcaaacaatagaacgattctgcccatggtttctagaacagggaactttagatctaaaagattggagaaaaattggaaaacaattaaaacaagcaagtagggagggtaaaatcatctcacttacagtatggaatgattgggtcattattaaagtagctttggaacggtttcaaacagaa

SEQ ID NO: 125 - DNA, 3725 bp, Homo sapiens
gtcaggcctctgagcccatgccaagccatcgcatcccctgtgacttgcacgtatacgcccagatggcctgaagtaactgaagaatcacaaaagaagtgaatatgccctgccccaccttaactgatgacattccaccacaacagaagtgtaaatggccggtccttgacttaactgatgacattaccttgtgaaagtccttttcctggctcatcctggctcaaaaagcacccccaccgagcaccttgcgacccccactcctgcccgccagagaacaaaccccctttgactgtaattttcctttacctacccaaatcctataaaacggcgccacccttatctcccttcgctgactctcttttcggactcagcccgcctgcacccagtgaaatacacagccatgttgctcacacaaagcctgtttggtggtctcttcacacgcacgggcatgaaatttggtgccgtgactcagattgggggacctcccttgggagatcaaccccctgtactcctgttctttgctccctgagaaagatctacctatgacctcaggtcctcagaccaaccagcccaaggaacatctcaccaattttaaatcaggtaagtggcctcttcttactctcttctccaacctctctcactgtccctcaaccactttctcctttccactcttcaatctctcccttctcttaatttcaattcctttcattttctgggagagacaaaggagacatgttttatctgtggacccaaaactccggcaccggtcacgcactgggaaggcagccttcccttggtgtttattcattgcagggatgcctctctgattatacacccacatttcaagggtgtcagaccacgcagggacgcctgccttggtccttcacctttagcggcaagtcctgcttttctggggaagggacaagtaccccaaccccttctctccttgtctctaccccttctctgcttttctgggagaggggcagtacccctcaaccccttctccttcacccttagtggcaagtcccgcttttctatggggcaagaatccccagtcccttatttccatgccccaacctcttatctctgtgccccaatcccttatttccatgccccaacctcttatctctgtgccccaatcccttatttctgcaccctgacctcttatgtctgtgccccaatcccttatttccacaccccaacctcttatctctgtgtcccaatcccttatttccgcaccccaacctctctctgtgccccaatcccttatttccatggcccaacctcgtatctctgcaccccaatcccttatttccactccccgacctcttatctctgcgctccaacccctttcccacttttctggaaggtaagaacccccgaaccccttccctccatttctctattctctcttttctctagacttgcttccttcactatgggcaaacttccaccctccattcctccttctactcccttagcctgtgttctcaaaaacttaaaacctcttcaactcacacctgacctaaaacgtaaatgccttattttcttctgcaatgccacttgaccccagtacaaactcgacagtagttccaagtagccagaaaatggcactttgaatttttccatcctgcaaaatctaaataattcttgtcgtaaaataggcaaacggtctgagatgcctgatgtccaggcattcttttacacatcagtcccttcctagtctctgtgcccagtgcaacttgtcccaaatcttccttctttccctcctgcctgtcccctcagtaccaaccccaagcgtcactgagtctttctaatcttccttttctacagacccatctgacctctcccttcctccccaggctgctcctctccaggcggagctaggtcccaattcttccacagcctctgctcctccaccctataatctttttatcaactcccctcttcacacctggtccggcttacagtttcgttccatgactagccctccccctcctgcccagcaatttactcttaaaaaggtggctggagctaaaggcatagtcaaggttaatgctcccttttctttatcccaaatcagatagtgtttaggctctttttcatcaaatataaaaatccagccccgttcatggctcgttcggcagcaaccctgagatgctttacagccctagaccctaaaaggtcaaaagggcgtcttattctcaatatacattttattacccaatctgctcccgacattaaataaaactccagaaattggaatctggccctcaaaccccacaacaggacttaattaacctcaccttcaaggtgtacaataacagaaaacagttgcaattccttgcctccactgtgagacaaaccccagccacatctccagcacacaagaacttccaaatgcctgaaccgcagtggccaggtattcctccagaacctcctcccccaggagcttgctacacatgccagaaatctggccactgggccaaggaatgcccgcagcctgggattcctcctaagccacgtcccatctgtgtgggaccccactgaaaatcggactgttcaactcacctgacagccactcccagaacccctggaactctggcccaaggctgactgactccttcccagatcttctcggcttagcggctgaagatgacactgcccaatcaccttggaagccccctagaccatcacggacgccgagcttcaggtaactctcacggtggaaggtaagcccgtccccttcttaatcaatacggaggctacccactccacattatcttcttttcaaggacctgtttcccttgcctccataactgttgtgggtattgacggccaggcttctaaacctcctaaaactccccaactctggtgccaacttagacaatactcttttaagcactcctttttcattatccccacctgcccagttcccttattaggctgagacactttaactaaattatctgcttccctgactattcctggactacagctgtatctcattgccacccttcttcccaattcaaagcctcctttgcgtcctcctcttgtatccccccaccttaacccacaagtataagatacctctactccctccttggctaccaatcatgcaccccttaccatctcattaaaacctaatcacccttaccccactcaatgccaatatcccatcccacagcacgctttaaaaagattaaacctgttatcactcgcctgctacagcatggccttttaaagcctataaactctccttacaattcccccattttacctgtcctaaaaccagacaagccttacaagttagttcaggatctgtgccttatcaaccaaattgttttgcctatcccccctgtggtgcccaacccatatactctcctatcctcaataccttcctccaccactcactattccgtgcttgatcttaaagatgcttttttcactattcccctgcacccctcgtcccagcctctcttttctttcacttggactgaccctgacacctattaggctcagcaaattacctaggctgtactgccacaaggcttcatagacagcccccattacttcagtcaagcccaaatttcatcctcatctgttacctatctcggcataattctcataaaaacatacgtgctttccctgctgatcgtgtcctattaatctcccaaacctcaatctcttacaaaacaacaactcctttccttcctaggcatagttag

SEQ ID NO: 126 - DNA, 5535 bp, Homo sapiens
aactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatatactttgtgagatccacccctgcccaccagaggacaaccccctttgactgtaattttccattaccttcccaaatcctataaaacggccccacccgtatctcccttcgctgactctcttattggactcagcccacctgcacccaggtgaaataaacagccatgttgctcacacaaagcctgtttggtggtctcttcacacagacgcgcatgaaatttggtgccgtgactcggatcgggggacctcccttgggagatcaatcccctgtcctgctgctctttgctccgtgagaaagatccacctatgacctcaggtcctcagaccgaccagcccaagaaacatcgcaccaatttcaaatccggtaagcggcctctttttactctcttctccaacttccctcactatccctcaacctctttctcctttcaatcttggcgctacgcttcaatctctcccttctcttaatttcaattcctttcattttctggtagacacaaaagagacgttttatccgtggacccaaaactccggcgccggtcacggactgggaaggcagccttcccttggtgtttaatcaatgcagggacgcctctctgattatacacccacgtttcaagggtgtcagaccacgcagggacacctgccttggtccttcacccttagcggcaagtcctgcttttctggggaaggggcaagtagcccaaccccttctctccttgtctctaccccttctctgctttcctggggcaggggcaagtacccctcaaccccttctccttcacccttagcggcaagtcccgctttcctggggcaggggcaagtacccctcaaccccttctccttcacccttagcggcaagtcctgcttttctagggggcaagaacccccaaaccacttccctccgtgtctctacgctctctgttctctgggcttgcctccttcactatgggcaagcttccaccttccattcctccttcttctcccttagcctgtgttcttaagaacttaaaacctcttcaactctcacctgacctaaaatctaagcatcttattttcttctgcaatgccgcttgaccccaatacaaactcgacagtagttccaaatagccagaaaacagcactttcaatttttctgtcctacaagatctaaataattcctgtcgtaaaatgggcaaattgtctgaggtgcctgacgtccaggcattcttttacacatcagtccattcctagtctctgtgcccaatgcaactcgtcccaaatctcccgcctgtcccctcagtcccaacgccaagcatcgctgagtctttctaatcttccttttctacagacccatctgacctctcccctcctagccaggccaagctaggtcccaattcttcctcagcctccactcctccaccctataatctttttatcgcttcccctcctcacacctggtcgggcttacagtttcattccgtgactagccctcccccacctgcccagcaatttattcttaaaaaggtggctggagctaaaggcatagtcaaggttaatgctcctttttatttatcccaaatcagatagcgtttaggctttttcatcaaatataaaaaccctgcccagttcatggctcgttcggcagcaaccctgagactctttacagccctagaccctgaaaggtcaaaaggccatcttattctcaatatacattgtattacccaatctgctcccgacattaaataaaactccaaaaattaaattctggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccacagcagccaggcttcctccagaacctcctcccccaggagcttgctacaagtgccagaaatctgaccaccaggccaaggaatgcctgcagcccaggattcctcctaagccatgtcccatctgtgcgggaccccactggaaactggactgttcaactcacctggcagccactcccagagcccctggaactctggcccaaggctctctgactgactccttctcggcttagcggctgaagactgatgctgcccgatcgcctcggaagccccgtagaccatcacggacaccgagctttgggtaactctcacagtggaaggtaagtccgtccccttcttaatcaatatggaggctacccactccacattaccttcttttcaagggcccgtttccgttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgccgcccttcttcccaatccaaagcctcctttgtgtcctcctcttatatccccctaccttaacccacaagtataagatacctctactccctccttggcgaccgatcatgcaccccttaccatctcattaaaacctaatcacccttaccccgctcaatgtcaagatcccatcccacagcacgctttaaaaggattaaagcctgttatcactcgcctgctacagcatgaccttttaaagcctataaactctccttaccattcccctgttttacctgtcctaaaaccagacaaggcttacaagttagttcagaatctgcgccttatcaaccaaattgttttgcctatccaactcgtggtgccaaatccatatactctcctatcctcaatacctctctctactacccattattctgttctagatctcaaacatgctttctttactattcctttgcacgcttcatcccagcctctctttgctttcacttagactgaccctgacacccatcaagctcagcaaattaccttggctgtactgccgcaaggcttcacagacagcccccattacttcagtcaagcccaaatttcaccctcatctgttacctatctcggccaaattctcataaaaacacacgtgctttccctgctgatcgtgtctgattaatctcccaaacctcaatccctttcaaaacaacaactcctttccttcctaggcatggttagtgcggtcagaattcttacacaagagccaggaccgcaccctgtagcctttctgtccaaacaacttgaccttactgttttagcctagccctcatgtctgcgtgcagcggctgccgctgctttaatacttttagaggccctcaaaatcacaaactatgctcaactcactctctacatttctcataacttccaaaatctattttcttcctcatacctgatgcatatactttctgcttcccggctccttcagctgtactcactctttaagtcccacaattaccattgtttctggcccggacttcaatccggcctcccacattattcctgataccacacctgacacccatgactgtatctctctgatccacctgatattcaccccatttccccatatttccctctttcctgttcctcaccctgatcacgcttgatttattgatggcagttccaccaggcctaatcgccgcataccagcaaaggcaggttatgctatagtacaagccactagcccacctctcagaacctctcatttcctttccatcgtggaaacctgtcctcaaggaaataacttctcagtgttccatctgctattctactactcctcagggattattcaggccccctcccttccctacacatcaagttcgaggatttgcccctacccaggactggcaaattagctttactcaacgtgcctgagtcaggaaactaaaatacctcttagtccaaatagacactttcactgaataagtaaaggtctttcctacagggtctgagaaggccaccgcagtcatttctttccttctgtcagacataattcctcagtttagccttcccacctctatacagtctgataacggaccagcctttattagtcaaatcagccaagcagtttttcaggctcttagtaggtttcagtgaaaactttatatcccttacggtcctccgtcttcaagaaaagtagaacggactaaagatcttttaaaaacacagctcaccaagctcagccaccaacttaaaaggactgacaatacttttaccacttttgcttctcagaattcaggcctgtcctcaatgctacaaggtacagcccatttaagctcctgtatagacgctcctttttattaggccccagtctcatttgacaccagaccaacttagactgtgccccaaaaaaacttgtcatccctactatcttttgtccagtcatactcctattcaccgttctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagtttctcaattcatccaaaaccgtatccaggccatcaccaatcattctatacaacaaatgtttcttcttacatccccacaatatcaccctttaccacaagacctcccttcagcttaatctctcccactctaggttcccacgccgcccctaatcctgcttgaagcagccctaagaaacattgcccattctctctccataccacccccacaaaaattttcgccgccccaacacttcaacactattttgttttgtcttattaatataagaaggcaggaatgtcaggcctctgagcccaggccaggccatcgcatcccctgtgacttgcacgtatacatccagatggcctaaagtaactgaagatccacaaaagaagtaaaaacagccttaactgatgacattccaccgtgtgatttgttcctgccccaccctaactgatcaatgtactttgtaatctcccccacccttaagaaggttctttgtaattctccccacccttgagaatgtactttgtgagatccacccctgcccaccagagaacaaccccctttgactgtaattttccattaccttcccaaatcctataaaacggccccacccatatctcccttcgctgactctcttttcggactcagcccacctgcacccaggtgaaataaacagccatgttgctcacacaaagcctgtttggtggtctcttcacacggacatgtatgaaa

SEQ ID NO: 127 - DNA, 717 bp, Homo sapiens
ttacagtaggtagctagtcaggcatgagcggggcaggagagggctccccccagtacacacacacacacacacacacacacacacacacacacacaccacgaatgtcaagtgaccatcaggtggttaactgtctctctaaaataataattggtcacagatgacaccagggaaaagcagtctcctgatagatagaaaaaaccctgaaattggtgttcagtagcttcctgataagatctcaggagttgggtgagtggactcaagcatgcgcattaagaggcaaaatggcaaaatttaactggtacatgacattctaggaacattcgactggtaagggaagaatgcctcaagtgagcgtgcatacagctccggtaaattcactgtacatgttcacctcccaagtgctagcaggtcaatgcacatgcaagcatcccaccccaagggaagaattgagaagaagggatgcaagaccccagaaatatgccaacatataaaacctcaactcaaaaggtcaaactgcatacttgatctctcaagttgccagcttggccctcttccaagtgtactttacttccttccattcctgctctaaagctttttaataaactttcacttctgctctaaaatttgcctcaggctctctttctgccttatgcccctctgtcgaattctttcttctgagaaggcaagaattgaggttgctgcagacccatacagatt

SEQ ID NO: 128 - DNA, 1266 bp, Homo sapiens
ttacagcaggtagctagtcagacaggaacagggcaggagagcccccctgactccctccctctctccctcaccaatcaggaatgtcaggcaaccatcaagtgatggtgaggtagttgttaagtatctctctaaaaaaataattgatcaatgacagggaaaggcagtctcccaatacacagaaacacctgtaattgctgatcagcagcttcccgatgacatctcaggagttgggcaagcgggctcaagcatgagcactaagaggcaaaatggcggagtttaaccggtatagcatttggactggtaaaggaagaatgcctcatgtgagcatgcgtacaactccagtaaacgcaccacgcatgcagcccctcccaagtgctactgggccactgtacatgggcacagcccaccgcaagggaagaatcaggggagaagtttttaataaactttcactccttctctaaacttgcctcggtctctcactctgctcttcgtttggattctttcttctgaggagacaagaactgaggttgctgcagacccgtatggattcgccgccgcttacatactttggtgctgtgtgacttgggtacattcagttggtaacataactaggaaggggtgtataggcacatgggtggaaaaaagtatgtataaagctccatcctcatggagcttacattctaatgacagggagacagacaaaaaccaaactaccaaacaggtcagatgttaagtgttgtaagaaaaataaagtaaggcggggttacagagagagccatggggacagagcattgcagtattgaaaggtggttaaaggaccccacatagactgcaacattcgagcaaaatgcataaaggattgagggaactgaccatgcaggtaatgggggaagagcatttttcaagcagaagcaatgtcatatgtaaaagctacaaaaatattaaagaaagctttttgggtagaggaaaaatgacaccaaattgaaacagatttataaaaaggggtaagtgccagggaaaggcagtctcctgatggacagaaacatctgaaactggtgatcagcagcttcctgataagatctcaagaactgggatcttataagattcttgataagattctgtcaattcttgataagatcaagaattgggcaagcgggcttaagcatgcccactaagaggcaaaatggcagagtttaactggtttaactttcggactggtaagggaagaatgcctcacgcattcagcaactccagtaaacacactgc

SEQ ID NO: 129 - DNA, 290 bp, Homo sapiens
gacttggatcggggggcctcccttgggagatcaatcccccgtcctcctgctttttgctccttgagaaagatccacctaggacctcaggtcctcagaccgaccagcccaagatacatctcaccaatttcaaatccgccactcccagagcccctggaactctggcccaaggctctctgactccttcccagatcttctcggcttagcggctgaagactgacactgcccgatcgcctcggaagccctctaccccatcacggacgccgagctttcggtaactcttacggtggaag

SEQ ID NO: 130 - DNA, 185 bp, Homo sapiens
tcaatctatcacgaccctttcacgtggaccccttagaggtgtaagcccttaaaagggccaggaactctgttttcggggagctcggttcttgagacgcgagtctgccgaagctcccggccgaataaagccaaatccttccttaacctggtgtctgaggggttttgtccgcagctcgtcctgctaca

SEQ ID NO: 131 - DNA, 5785 bp, Homo sapiens
gtcaggcctctgagcccaagcctgcacgtatacatccagatggcctgaagcaaatgaagaatcacaaaagaagtgaacatggctggatcctgccttaactgatgacattaccttgtgaaatgacttctcttggctcagaagctcccccactaagcaccctgtgacctccgcccctgcccaccaaagaacaaccccctttgactaattttccattacctacccaaatcctataaaacagccacaccccatcacccttcgctgactctcttttccaactcagcctgcctgcacccaggtgattaaaaaactttattgctcacacaaagcctgtttagtggtctcttcatatggatgcctgtgaaatttggtgccgtgactcggatctggggacctcccttgggagatcaatcccctgtcctcctgctctttgttctgtgagaaaggtccacttatgaccttgggtcctcagaccaaccagcccaagaaatatctcaccgattttaaatcgggtaagtggcctctctttactctcttctccaacctctctcactatccctcaacttctttttcctttcagtcttggcgccatccttcaatctctctcttctcttaatttcagttcctttccttttctggtagagacagaggagacgcgttttatccgtgaacccaaaactccagtgccggtcacgaactcaggaaaactgtcttcccttggtgtttaatcacttaatcactgtggggacgcctgcttgattactcacccacatttcagtggtgtctgatcactacggggatgcctgccttgatccttcacccttggggcaagcaccccccaccctttctctccatgtctctaccctctcttttctctccactttcctggggggggcaagcaccccccaccccttctctccgtgtctctatcctctcttttctctgggcttgcctccttcactatgggtaaccttctaccctccattcctccctcttctcccttagcctgggttcccaaaaacgtaaaacctgaactcacacctgacctaaaacctaaacaccctattttcttctgcaatgccacttaaccacaaaacaaacttgacaatggttccaaatagtcagaaaatgacactttcaatttttccatcctacaagatctagataattcttgtcataaaatggacaaatggtctgaggtgcctgacatctaggcatccttttacacatcagtccctccctagtctctgctctgaatgcaactcatcccaaatcttccttctttccctccctcctgtaccctcagttccaacctcaagtgttgctgagtcttttcaatcttcccttttcaccgacccatctgaactctccccttctccccagactgcttctcctcaggttgctccgtgccaggctgaatcaggctccaattcttcctcagcctccactaccccaccctgtaatccttctatcacctcccctcctcacacacggtctggcttacagttttgttccacaactagccctcccccacctgcccagcaatttccttttaaaaaggtggctagagctaaaggcattagtcaaggttaatgctcctttttcttcatctctctctttgacctctctcaaatcagttagcgtgtaggctctttttcatcaaatataaaaacccagcccagttcatggcccatttggcaacaaccgttagacgctttatagccctagaccctgaagggtcagaaggctgtcttattctcaatatgcattttattacccaatccgctcccaactttaagtaaagctccaaaaattaaattctggcccccaaaccccacaacaggacttaattaacctcgccttcaaggtgtacgataatagagaagagttgcaattatgtgcctctgctgtgagagaaaccccagccacatctccagcacaaaagaacttcaaaacacctaagccacagtggtcaggcattccttcaggacttcctcccccaagatcttgcttcaagtgctggaaatctggctactgggccaaggaatgcccgcagcccaggattcctcctaagctgtgtcccatctgtgtgggaccccagtggaaattggactgtccaactggcccaaggctctgactgactccttctcagatcttctcggcttagcggctgaagtctgacgctgcccgatcacctcagaagcctcctggacaatcacagatgctttgggtaactcttacagtggagggtaagtctgtccccttcttaatcaatacagaggctacccactccacattaccttcttttcaagggcctgtttcccctccctccataacagttgtgggtattgacggccaggcttctaaacctcttaaaactccccaactctggtgccaacttggacaatattcttttatgcactcctttttagttatccccacctgtccggttcccttattaggctgagacactttaactaaattatctgcttccctgactattcctaggctacagccacacctcattgccacccttttccccagttcaaagcctccttcacatcctccccttgtatctccccaccttaatccacaagtataggacacctctactccctccttggtgacccatcatgcaccccttaccatcccattaaaacctaatccccattcaatgccaatatcccatcccacagcacagtttaaaaggattaaagcctgttatcacttgcctgttacagcaaggccttttaaaggctataaactctccttacaatttcctcattttacctgtcctaaaaccagacaagccttacaggttagttcaggatctgcgccttatcaaccaaattgttttgtctatccaccccatcgtgccaaacccatatactctcctatcctcgatacctccctccacaacccatctgttctagataaacctagctgaccccataaatcctaaatcctttcctcattcacctttccattccttaaaaaacagccctaaaagctgctcccatactagctctccctaactcatcccaacctttttcttttttatttcttttcttttctttttttttgagaaggagtctcactctgttgcccaggctggagtgcagtggcgtgatctcggctcactgcaagttccgcctcctgggttcacaccattctcctgcctcagcctccccagcagctaggactataggtgcacaccaccacacccagctaatttttgtatttttagtggagacggggtttcactgtattagccaggatggtcccaatctcctgaccttgtgatctgcccccgccttgggctcccaaagtactgggattacaggcgtgagccaacgcacctgaccatcccaacctttttcattacacacagccaaagtgcagggctgtggggtcaaaattcttacacaaggaccgggaccgctccctgtggccttttaatccaaacaacttgaccctactgttttagcctagccctcatgtctgtgtgcggcggctgccgctgccttaatacttttagaggccctcaaaatcacaaagtatgctcaactcactttctacagttctcatttcttccaaaatctattttcttcctcacacctgacacatacactttctgctccccagctccttcagctatactcactctttattgagtctcccacaattaccattgttcctggcccagacttcaatccagcctcccatattattctggataccacacctgacccccatgactgtatctctctaatccacctgacattcactccatttcctcttatttccttctttcctgttcctcaccctgatcacacttggtttattgatggcagttccaccaggcttaatcgttgctcaccggcaaaggcaggctatgctatagtatcttccacatctgtcattgaggctaccagtctgccccactgcactacctctcagcaagccgaacacattgccttaacttgagccctcactcttgcaaagggatgacgtgtcaatatttacactgactaaatatgccttccttatcctgcacaccatgctgttacatgggctgaaaaaggttttctccgtaagtaagggtcctccatcattaatgcctctttaataaaaattcttctcaaggccactttacttccaaagaaagctggagtcattcactgcaagggccatcaaaaggcatcagatcccatccctcagggcaatgcttatgctgagaaggtagctaaaaaccagctagacttccaacttcagtccctcacggccagtttttctcctttttatgggtcactcccacctactctcccactgaaacttccacctatcaatctcttcccacacaaagcaaatggttcttggaccaaggaaaatatctccttccagcctcataggcccattctgttctgtcatcatttcataacatcttccatgtaggttacaagccactagcctgtctcttagaacctctcatttcttttccatcatggaaatctatcctcaaggaaatcagttctcagtgttccatctgctattctactaatcctcagggagtgttcaggccccctcccttccctacacaccaagctcggagatttgcccctgcccaggactggcaaattgactttacttacatgccccagtcaggaaactaaaatacctcttggtctggatagacactttcgctttataggtagaggcctttcccacagggtctgaaaaggccaccacagtcattgcttcccttctgttagacataattccttggtttggccttcccacttctatacaatccaataatggaccggcctttattagtcaaatcacccaagcagtttttcaggctcttggtattcagtggaatcttcataccccttaccatcttcaatcttcaggaaaggtagaacagactaatggtcttttaaaaacacacctcaccaaactcagcctctaacttaaaaaggaggactctatcaaggatagagctccaaaattcaccgaccaagcaagtaataacgctgaacccccttgggcacgctctaattggatgtcctgggtcctcccaattcttagtcctttaatatctgtttttctccttctcttatttggaccttgtgtcttccatttcatttttcaattcatacaaaaccgcatccaggccatcaccaatcattctatacaagaaacgctccttctaacaaccccacaatatcacaccttcccacaaaatcttccttcagcttaatctctcccactctaggttcccatgccacccctaatcccactcaaagcagccctgagaaacatcccgattatctctccataccaccccccaaaaattttcgctgccccaacatttcaatactattttattttatttttcttattaatataagaagacaggaatgtcaggcctctgagcccaagcctgcacttgtacaaccagatggcctgaagcaagtgaagaatcacaaaagaagtgaaaatggctggttcctgccttaactgatgacattaccttgtgaaattccttctggctcagaagctcccccactgagtaccttgtgacccccgcccctgtccgccaaagaacaacccccttagactgtaattttccattacctacccaaatcctataaaacagccccacccctatctcccttcactgactctcttttcagattcagcccgcctgcacccaggtgattaaaaagctttattgctcacacgaagcctgtttggtggtctctccacttggacgcgtatgaaa

SEQ ID NO: 132 - DNA, 971 bp, Homo sapiens
gtggacgaaagaaagagagatcagactgttactgttgtctatgcagaaagaagaagacataagaaactccattttgttctgaactaagaaaaattcttctgcctttagatgatgttaatctgtaaccctagccccaaccctgtgctggcagaaacatgtgttgtgttgactcaaggtttaatggatttagggctacgcagggtgtgctttgttaaaaatgtgtttgcaggcagtatgcttggtaaaagtcaccgccattttccagtctcaagtacccagggacacaatgcactgcggaaggccgcagggacctctgcccaagaaagcctgggtattgtccaaggtttctccccactgagacagcctgagatatggcctcgtgggaaggtaaagacctgaccgtctcccagcctgacaccagtaaagggtctgtgctgaggaggattagtgaaagaggaaggcctctttgcagttgagataagaggacggcatctgtctcctgctcatccctgggaatggaatgtctcggtgtaaaacccgacgtacattctatttactaagatggaaaaaaccgccttatggctggaggtgagacatgctggaggcaatactgctctttactgcactgagatgtttgtgtaaagtcaaacataaatctggcctatgtgcacatcgaggcatagaacctttccttaaacttatttacgacacagagacctttgctcacatgttttcctgctgaccctctccccaccattatcctatagtcctgccacatccccctcaccgagatagtagagatagtgatcagtaaatactgagggaactcagagaccagtgccgggtcctccgtatgctaagcgccgtcccccgggcccactgttctttctctatacttcatctctgtgtcttatttctttcctcagtctctcatcccacctgacgagaaacacccacaggcgtggaggggc

SEQ ID NO: 133 - DNA, 4044 bp, Homo sapiens
tcaggcctctgagcccaagccaagccatcacatcccctgtgacttgccggtatatgccctgatggcctgaagtaactgaagaatcacaaaagaagtgaatatgccctgccccaccttaactgatgacattccaccacaaaagaagtgtaaatgactggtccttgccttaagtgatgacattaccttgtgaaagtccttttcctagctcatcctggctcaaaaagctcccccactgagcatcttgcgacccccactcctgcctgccagagaacaaaccccctttgactgtaattttcctttacctacccaaatcctataaaacggccccacccctatctcccttcactgactctcttttcagactcagcccgcctgcacccaggtgaaataaacagccatgttgctcacacaaagcctgtttggtggtctcttcacacggatgcgcatgaaatttggtgccgtgactcggatcaggggacctcccttgggagctcaatcccctgtactcctgttctttgctccgtgagaaagatccacctatgacctcaggtcctcagactgaccagcccaaggaacatctcaccaattttaaatcaggtaagcggcctcttcttactctcttctccaacctctctcactgtccctcaaccactttctcctttccactctttaatctctctcttctcttaatttcaataactttcattttctgatagagacaaaggagacacgttttatccatggacccaaaactccggcgctggtcacggactgggaaggcagccttcccttggtgtttaataattgcagggacgcctctctgattatacactgacgtttcaagggtgtcagaccacgcagggacgcctgccttggtccttcacccttagtggcaagtcccgctttcctggggcaggggcaagtaccccaaccccttctccttcacccttagcagcaagtcctgcttttctagggggcaagaacccccaatcccttatttccacgccccaacctcttatctctgtgccccaatcccttatttccgcaccccgacctcttatctctgtgccccaatcccttatttccacgccccaacctcgtatctctgcaccccaatcccttatttccatgccccgacctcttatctctgtgccccaacccctttccccacttttctggaaggtaagatcccccgaaccccttccctctgtttctctactctcttttctctaggcttgcttccttcactatgggcaaccttccaccctccattcctcctcctactcccttggcctgtgttctcaaaaacttaaaacctcttcaactcacacctgacctaaaacttaaatgccttattttcttctgcaatgccacttgaccccaatacaaactcgacagtagttccaaatagccagaaaatggcactttgaatttttccatcctgcaagatctaaataattcttgtcataaaataggcaaacggtctgaggtggctgacgtccaggcattcttttacacatcagtcccttcctagtctctgtgcccagtgcaactcgtcccaaatcttccttctttccctcccacctgtcccctcagtaccaaccccaagcgtcgttgagtctttctaatcttccttttctacagacccatctgacctctcccttcctccccaggctgctcctcgccaggccgagctaggtcccaattcttcctcagcctctgctcctccaccctataatccttttatcacctcccctcctcacacctggtccggattacagtttcgttccgtgactagccctccccctcctgcccagcaatttactcttaaaaaggtggctggagctaaaggcatagagtcaaggttaatgctcctttttccttatcccaaatcagaagcgtttaggctctttttcatcaaatataaaaatccagcccagttcatgacttgtttggcagcaaccctgagacgcttcacagccctagaccctaaaagttcaaaaggccgtcttattctcaaaatacattttattacccaatctgctcccaacattaaataaaactccaaaaattaaattccggccctcaaaccccacaacaggatttaattaacctcgccttcaggcatacaataatagaaaaaagttgcaattccttgcctccactgtgagacaaaccccagccacatctccagcacacaagaacttcaaaacgcctgaaccgcagtggccaggcgttcctccagaacctcctcccacaggagcttgctacacatgccagaaatctggccactgggccaaggaatgcccgcagcccgggattcttcctaagccacgtcccagctctgtgggaccccaccgaaaatcggactgttcaactcacctggcagccactcccagagcccctgtaactctggcccaaggctctctgactgactccttctcagatcttctcggcttagcggctgaagactgacactgcccgatagcctcggaagccccctagaccatcacggacgccaagcttcgggtaactctcacagtggaaggtaagcccatccccttcttaatcaatacggaggctactcactccacattaccttcttttcaagggcctgtttcccttgcctccataactgttgtgggtattgatggccaggcttctaaacctcttaaaactccccaactctggtgccaacttagacaatactcttttaagcactcctttttagttatccccacctgcccagttttcttattaggctgagacactttaactaaattacctgcttccctgactattcctggactacagctatatctcattgccgcccttcttcccaatccaaagcctcctttgcgttctcctcttgtatccccccaccttaacccacaagtataagatacctctactccctccttggcgaccaatcatgcaccccttaccatctcattaaaacctaatcacccttaccccactcaacgccaatatcccatcccgcagcacactttaaaaagattaaagcctgttatcactcgcctgctacagcatggccttttaaagcctataaactctccctacaattcccccattttacctgtcctaaaaccagagaagccttacaagttagttcaggatctgcgccttatcaaccaaattgttttgcctatccaccccgtggtgccaaacccatatactctcctatcctcaatacctgcctctacaacccattattctgttctggatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcaactgttacctatcttggcataattctcataaaaacacacgtgctctccctgccaatcgtgtctgactgacccctcaaaccccagcaccttctacaaaacaacaactcctttccttcctaggcatggttagcgcggtcagaattcttacacaagagccaggcccacaccctgtagcctttctgtccaaacttgaccttactgttttagcctagccctcatgtctgcgtgcagtggctgccgctgctttaatacttttagaggccctcaaaatcacaaactatgctcaactcactctctacagttctcataacttccaaaatctattttcttcctcatacctgatgcatatactttctgcttcccggctccttcagctgtactcactctttgttgagtctcccacaattaccgttgttcctggcccagacttcaatccggcctcccacattattcctgataccacacctgacccccatgactgtatccctctgatccacctgacattcaccccatttccccaaatttccttcttttctgttcctcaccctgatcatgcttgatttattgatggcggttccacccaggcctaatcgccacacaccagtaaaggcaggttatactatagca

SEQ ID NO: 134 - DNA, 5809 bp, Homo sapiens
gtcaggcctctgagcccaagctaagccatcatatcccctgtgacctgcacatacacatccagatggccagttcctgccttagctgatgacattatcttgtgaaattccttatcctggctcatcctggctcaaaagctcccctactgagcaccttgtgacccctactcctgcctgccagagaacaacccccctttttcatttacctacccaaatcctataaaatagccccacccctagctcccttcactgactctcttttcagactcagcccgcctgcacccaggtgaaataaatagcctcgttgctcacacaaagcctgtttggtggtctcttcacatggacacacatgaaatttggtgccgtgactcgaactgggggacctcccttgggagatcaatcccctgtcctcctgctctttgctccatgagaaagatccacctacgacctcaggtcctcagactgaccagcccaagaaacatcttaccaatttcaaatccggtaagcggcctctttttactctcttctccaacctctctcactatccctcaacctctttctcctttcaatcttggcaccacacttcaatctctcccttctcttaatttcaattcctttcattttctggtagagacaaaggagacacgttttatccgtggacccaaaactccagtgccagtcatggactagggaaggcagccttcccttggtgtttaatcattgcagggatgcctctctgattattcacccaggtttcagaggtgtcagtccacgcagggacgcctgctttggtccttcacccttagcggcaagtcccacttttctgggggaggggcaagaaccccaaccccttctctgtgtctctaccccttctccgcttttctgggggagaggcaagaacccctcaaccccttcaccttcacccttagtggcaagtcccacttttctaggggaggggcaggaaccctgacctcttatctctgtgccccgatcccttatttccatgccctaacctcttatctctgtgccccaatcccttatttccacgcccccaacctcttatctctgtgccccaaccccttatttccatgccccaaaccccttctctgcttttctggagggcaagaacccccacctcttctccgtgtctctactctcttttctctgggcttgcctccttcactatgggcaagctttcaccttccattcctccttctcccttagcctgcgttcttaagaacttaaaacctcttcaactctcacctgatctaaaatctaagcatcttattttctcctgcaatgccgcttgaccccaatacaaacttgacagtggttccaaatagccggaaaacggcactttcaatttttccatcctacaagatctaaataattcttgtcgtaaaatggacaaatggtctgagatgcctgacgtccaggcattcttttacacatcggtccctccctagtctctgttcccaatgcaactcatcccaaatcttccttctttccctcccacctgtcccctcagtcccaaccccaagcgtcgctgagtctttctaatcttcctcttctacagacccatctgacccctcccctcctcgccaggcagagctaggtcccaattcttccttagcctccactcctccaccctataatacttttatcaccttccctcctcacacccggtccagcttacagtttcgttccatgactagccctccccaacctgcccagcaatttactcttaaaaaggtggctagagctaaagacatagtcaaggttaatgctccttttcctttatcccaaatcagagagtgtttaggctctttttcatcaaatataaaaatccagcccagttcatggctcatttggcagcaactctgagatgctttacagccctagaccctaaaaggtgaaaaggccgtcttattcttaatatacattttattacccaatctgctcccgacattaaataaaactccaaaaattaaattccggccctcaaaccccacaaccagacttaattaacctcaccttcaaggtgtacaataatagagtagagacagccaagtagcaatatatttctgagttgcaattccttgcctccactgtgagacaaaccccagccacatctccagcacacaagaacttccaaacgcctgaaccgcagcagccaggcattcctccagaacctcctcccccaggagcttgctacaagtgctggaaatctggccatcgggccaaggaatgcctgcagcctgggattcctcgtaagccgcgtcccatctctgtgggaccccactgaaaattggactgtccaactcacctggcagccactcccagagccccctggaactctggcccaaggctctctgactgactccttcccagatcttctcggcttagcagctgaagactgacactgcctgatcgcctcggaagccctgtagaccatcgtggacgccgagctttaggtaactctcacagtggagggtaagtccgtccccttcttaatcaatatggaggctacccacgccacattaccttcttttcaagggcctgtttcccttgcctccataactgttgtgggtattgacagccaggcttctaaacctcttaaaactccccaactctggtgccaacttagacaacactcttttaagcactcctttttagttatccccacctgctcagttcccttattaggccgagacactttaactaaacattctgcttccctgactattcctggactacagccacatctcattgccgcccttcttcccaatccaaagcctcctttgcatcctcctcttgtatccccccaccttaacccacaagtataggatacctctactccctccttggcaactgatcatgcatcccttaccatcccattaaaacctaatcacccttacctcgctcaatgccaataccccatcccacagcatgctttaaaaggattaaagcctgttatcactcgcctgctacagcatgggcttctaaaacctataaattctccttacaattcccccattttacctgtccaaaaaccggacaagtcttacagattagttcaggatctgtgccttatcaaccaaattgctttgcctatccaccctgtggtgcccaacctgtacactcttttgtcctcaataccttcctccacaactcactattctgttcttgatcttaaaaatgcttttttcactattcccctacacccctcgtcccagcctctcttcgctttcacttgtactgaccctgacacccatcaggctcagcaaattacctgggctgtactgctgcaagccctcacagatagcctccatcacttcagtcaagcccaaatttcttcctcatctgttacctatcttggcataattctcataaaaacacatgtgctctccctgccgatagtgtccaactgatctctcaaactacagcaccttctacaaaacaacaactcctttccttcctgggcatggttggatacttttgcctttggatacctggttttgccatcctaacaaaaccattacataaactcacaaaaggaaacctagctgaccccatagatcctaaatcctttccccactcatctttccattccttgaagacagctttagagactgtccccaccctagctcttcctgactcatcccaacccttttcattacacacagccgaagtgcagggctgtgcagtcagaattcttacacaaggaccgggattgcgtcctgtagcttctttgtccaaacaacttgaccttactgttttaggctggccatcatgtctccgtgcagcagctgctgccgccctaatacttttagaggcccttaaaatcacaaactacgctcaactcactctctacagctctcataacttccaaaatctattttcttcctcacacctgacgcatatactttctgctccctggctccttcagctgtactcactctttgttgagtctcccataattaccattgttcctggcccggacttcaatccgacctcccacattattccagataccacacctgacccctatgactgcatctctctgatccacctgacatttactccatttccccacatttccttctttcctgttcctcaccctgatcacacttggtttactgatggcagctccaccaggcctaatcgccacacaccagcaaaggcaggctatgctatagtacaagccactagcccacctcttagaacctctcatttcctttgcatcgtggaaatctatcctcaaggaaataacttctcagtgttccatctgctattctactactcctcagggattattcaggccccctcccttccctacacaccaagctcaaggatttgcctccacccaggactggcaaattagctttactcaacatgccccaagtcaaataactaaaatacctcttagtctaggtagacactttcactagataggtagaggcctttcctacagggtctgagaaggccactgcaatcacttcttcccttctgtcagacgtaattcctcagtttagccttcccacctctatacagtctgataacagaccagcctttattagtcaaaacagccacgcagtttttcaggctcttagtattcagtgaaacctttacatcccttacggtcctcagtcttcagggaaagtagaacagactaaaagtcttttaaaaacacacctcaccaagctcagccaccaacttaaaaaggactggacaatacttttaccactttcccttctcagaagtcaggcctgtcctcagaatgctacagggtacggcccatttgagctcctgtatagacactcctttttatcaggccccagtctcatcccagacaccagaccaacttggactgcgccccaaaaaacttgtcatctgtgctgttttctgtctagtcatactcctattcaccattctcaactactcatacatgccctgctcttgtttacagtgccagtttacactgtttttccaagccatcacagctgatacctcctgatgctatccccaaaccgccactcctaactcttaaagtaaataaataatctttgctggcaaggctatgctgaacctccttaagcactctctaattagatgtcctaggtcctcccaattcttagtcctttaatacctgtttttctccttctcttattccgtttagtttttcaattcatacaaaacggtatccaggccatcaccaataattctacatgacaaatgtttcttctaacaaccccccacaatgtcatcccttaccacaaaatcttccttcagcttaatctctcccactctaggctcccacaccgcccctaatcccgctcgaagcagccctgagaaacatcgcccattctctctccataccaccccccaaaaattttcaccatcccaacactttaccactatttcattttatttttcttattaatataagaagacaggaatgtcaggcctctgagcccaagctaagccatcatatcccctgtgacctgcacatacacatagagatggccggttcctgccttaactgatgacattatcttgtgaaattccttatcctggctcatcctggctcaaaagctcccctactgagcaccttgtgacccctactcctgcctgccagagaacaacccccctttttcctttacctacccaaatcctataaaatggccccacccctagctcccttcactgactctcttttcagactcagcccgcctgcacccaggtgaaataaacagtcttgttgctcacacaaagcctgtttggtggtctgttcacacggacgcacatgaaa

SEQ ID NO: 135 - DNA, 433 bp, Homo sapiens
ttacagtaggtagctagtcagacatgagcagggtgggagagtcccccccaccactaggaatgtcaggcaaccatcaggtgatggtcaggtggttattaaactgcctctctaaaattataattggtcacagccagtgccagggaaaagcagtctcccaattgataaaaacacctaaaactggcaatcagcagcctcctaagatctcaggagttgggcaagtgtcctcaagcatactcattaagaggcaaaatggtggagtttaactggtatatgaccttctatatgaacgtctatggatatttgactggtaagggaagaacgcctcaagtgagcctgcatagaactccaataaacacaacatgcatactcacctcccaagtgctggtaggccactacacatgcacacagcttaccccaagggaagaatcagggg

SEQ ID NO: 136 - DNA, 5873 bp, Homo sapiens
gtcaggcctctgagcccaagccaagccatcgcatcccctgtgacttgcatgtatatgcccagatggcctgaagtaactgaagaatcacaaaagaagtgaaaaggccctgccccgccttatctgatgacattccaccattgtgatttgttcttgccccaccttaactgagtgattaaccctgtgaatttccttttcctggctcagaagctcccccactgagcaccttgtgacccccgcccctgcccaccagagaacaaccccctttgactgtaattttccattaccttcccaaatcctacaaaacggccccacccctatctccctttgctgactctcttttcggactcagcccacctgcacccaggtgaaataaacaaccatgttgctcacacaaagcctgtttggtggtctcttcacatggacgcgcatgaaatttggtgccatgactcggatcgggggacctcccttgggagatcaatcccctgtcctcctgttctttgctccgtgagaaagatccacctacaacctcaggtcctcagaccgaccagcccaaggaacatctcaccaattttaaatcaggtaagcggtctcttcttactctcttctccaacctctctcactgtccctcaaccactttctcctttccactcttcaatctctcccttctcttaatttcaattcctttcattttctgggagagacaaaggagacatgttttatccgtggacccaaaactccggcgccggtcacagactgggaaggcagctttcccttggtgtttaatcattgcagggacgcctctctgattattcacccacgtttcaaaggtgtcagaccacgcagggacgcctgtcttggtccttcacccttagcggcaagtcccgcttttctggggaaggggcaagtaccccaaccccttctctccttgtctctaccccttctctgcttttctggggaaggggcaagtaccccaacccttctctccttgtctctaccccttctctgcttttccgggggtggggcaagtaccccaaccccttctctccttctctccaccccttctctgctttcctggggcaggggcaagtaccactcaaccccttctccttcacccttagcggtaagtcccgctttcctagggggcaagaaccccccaatcgcttatttccatgccccaacctcttatctctgcgccccaatcgcttatttccatgccccaacctcttatctctgtgccccaattgcttatttccgcgccccaacctgttatctctgtgccccaatcccttacttccatgccccaacctcttatgtctgcaccccaatcccttatttccatgctccgaccctttctctgcttttctggtgggcaagaaacccccaccccttctccatgtctctactcttttctctgggcttgcctccttcactatgggcaagcttccaccttccattcctccttcttcttccttagcctgtattcttaagaacttaaaacctcttcaattctcacctgacctaaaatctaagcatctcattttcttctgcaatgccgcttgaccccaatacaaactggacagtagttccaaatagccagaaaacggcactttcaatttttccatcctataagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccctccttgccaggccaagctaggtcccaattcttcctcagcctccgctcctccaccctgtaatctttttattgcctcccctcctcacacctggtccggcttacagtttcgttccgtgactagcccttccccacctgcctagcaatttactcttaaaaaggtggctggagctaaaggcatagtcaaggttaatgctcctttttctttatcccaaatcagatagcgtttaggctctttttcatcaagtataaaaatccagcccagttcatggctcgtttgacagcaaccctgagacgctttatagccctagaccctaaaaggtcaaaaggccatcttattctcaatatacattttattacccaatctgctcccgacattaaataaaactccagaaattggaatctggccctcaaaccccacaacaggacttaattaacctcaccttcaaggtgtgcaataacagaaaaaagttgcaattccttgcctccactgtgagacaaaccccagccacatctccagcacacaagaacttccaaacgcctgaaccatagcaaccaggcgttcctccagaacctcctcccccaggcgcttgctacacgtgccggaaatctggccactgggccaaggaatgcccgcagcctgggattcctcctaagccgcgtcccatctgtgtgggaccccactgaaaatcggactgttcaactcacctggcagccactcccagagcccaaggaactctgggcccaaggctctctgactgactccttcttggcttaccggctgaagactgacgctgcctgatcacctcagaagccccgtagaccatcacggacgccgagctttaggtaactctcacggtggagggtaagtccatccccttcttaatcaatacggaggctacccactccacattaccttcttttcaagggcctgtttcccttgcctccataactgttgtgggtattgacagccaggcttctaaacctcttaaaactccccaactctggcgccaacttagacactactcttttaagcactcctttttagttatccccacctgcccagttcccttattaggctgaggcactttaagtaaattatctgcttccctgactattcctggactacagctatatctcattgccgcccttcttcccaatccaaagcctcctttgcgtcctcctcttgtatccccccaccttaacccacaagtataagacacctctactccctccttggcgactgatcatgcaccccttaccatctcattaaaacctaatcacccttaccccactcaacgccaatatcccatcccacagcacgctttaaaaggattaaagcctgttatcactcgcctgctacagcatggccttttaaagcctataaactctccttacaattcccccattttacctgtcctaaaaccagacaagacttacaagttagttcaggatctgtgccttatcaaccaaattgttttgcctatcccccttgtggtgcccaacccgaacactcttttgtcctcaataccttcctccacaactcactattccgtgcttgatcgtaaagatgcttttttcactgttcccctgcacccctcgtccccgcctctctttgctttcacttagactgaccctgacacccatcaggctcagcaaattacctgggctgtcctgccgcaaggcttcacagacagcccccattacctcagtcaagcccaaatttcatcctcatctgttacctatctcggtataattctcacaaaaacacacgtgctttccctgctgatcatgtctgattaatctcccaaacctcaatcccttacaaaacaacaactcctttccttcctaggcatggttagtgtggtcagaattcttacacaagagccaggaccgcaccctgtagcctttctgtccaaacaacttgaccttactgttttagcctagccctcatgtctgtgtgcagcggctgccgctgctttaatacttttagaggccctgaaaatcacaaactatgctcaactcactctctacatttctcaacttccaaaatctattttcttcctcatacctgacgcatacactttctgctccccggctccttcagctgtactcactctttgttaagtcccacaattaccactgttcctggcccggacttcaatctggcctcccacattattcctgataccacacctgacccccatgactgtatctctctgatccacctgctattcaccccatttccctgtatttccttctttcctattcctcaccctgatcacgcttgatttattgatggcagttccaccaggcctaatcgccacataccagcaaatgcaggctatgctatagtacaagccactagcctgcctctcagaacctctcatttcctttccatcgtggaaatctatcctcaagaaaataacttctcagtgttccatctgctattctactactcctcagggattattcaggccccctcccttccctacacatcaagctcgagaatttgcccccacccaggactggcaaattagctttactcaacatgcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctctatacagtctgatagcagaccagcctttattagtcaaatcagccaattagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttcacttctcagaattcaggcctgtcctcagaatgctacaaggtacagcccatttaagctcctgtatagatgctcctttttattaggccccagtctcattccagacactggaccaacttagactgtgcccccaagaaaacttgtcatccctactattttctgtctagtcatattcctattctccattctcaactactcacacatgccctgctcttgttcacactgccagtttacactgtttctccaagccatcacagctgatatctcctcgtgctatccccaaactgccactcttaactcttgaagtaaataaataatctttgctggcaggactatgctgaatctccttaggcactctctaatcagatgtcctaggtcctcccaattcttagaccttttatacctgtttttctccttcttattccatttagtttttcaattcacacaaaactgtatccaggccatcaccaatcatactatatgacaaatgtttcttctaacaaccccacaatatcaccccttaccacaagatctcctttcagcttaatctctcccactctaggttcccacccgcccctaatcccgcttgaagcagccctgagaaacatcgcccattctctctccataccaccccccaaaaattttcgccaccccaacacttcaacactattttgttttatttttcttattaatataagaaggcaggaatgtcagtcctctgagcccaagccaagccatcgcatcccctgtgacttgcacgtatacgcccagatggcctgaagttactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccatccctatctccctttgctgactctcttttcggactcagcccacctgcacccaggtgaaataaacaaccatgttgctcacacaaagcctgtttggtggtctcttcacacggacacgtatgaaa

SEQ ID NO: 137 - DNA, 998 bp, Homo sapiens
ctttcacgtagacccccatagagttgtaagcccttaaaagtgtgtccagacttggttccctctggtggattcttggtctcactgacttcgagaatgaagctgcggaccttcacagcgagtgttacaacttttaaaggtggtgtggacccaaagagtcagcagcagcaagatttactgtgaaaagcgaaagaacaaagcttccacagagtggaaagggacctgagcaggttgccgctgctggctggggggtggccagcttttattcccttatttgtccccacccatgtcctgctgattggtccattttacagagtgctgattggtccattttacagagtgctgactggtgcatttttacagagttctgattggtgcatttaatcccttagttagacacagagtgatgattggtgtgtttttgcggagtgttgattggtgcacttacaatcctttagctagatgccaagtgctgattggtgcatttttacagagtgctgattggtgcgtttacaatcctttagctagacacagaatgctgattggtgcgtttacaatcctttagctagacacagtgcgctgattggtgcgcttttatagagtgctgattggtgcgtttacaatcctttagctagacacagagtgctgattggtgcatttttacagagtgctgattggtgcgtctacagtcctttagctagacacagagcgctgactggtgcatttttacacagtgctgattggtgtgtttacaatcctttagctagacacagagtgctgactggtgcgtttgcaatcctctagctagacagaaaagttctgcaagtccccactcaacccaggaagtccagctcgcttcacctctcaaaaaggccaggaattttttcttcagggagcttggttcttgagatgcaagtctgccaaggttcccagctaaataaagcctcttccctctttcagccggtgtctgaggagttttgcctgcagcccatcctgctaca

SEQ ID NO: 138 - DNA, 4482 bp, Homo sapiens
tcacaaaagaagtgaaaatggccaattcctgccctaactgatgacattaccttgtgaaattccttctcccggctcagacgctcccccactgagcacctcatgacccccgcccctgcttgccggagaacaacccctttgactgtaattttccactacctacccaactcctataaaatggccccacccctatgtccctttgctgactctttttggactcagcctgcctgcacccaggtgattaaaaagctttattgctcacacaaagcctctttggtggtctcttcacacggacgcgcgtgacatttggtgtcgaaacatttggtgccgtgactcggattgggggacctcccttgggagatcaatcccctgtcctcctgctctttgctccgtgagaaagatccatctacgacctctggtcctcagaccaaccagcccaaggaacatctcaccaattttaaattgggtaagcggcgtctttttactgtcttctctgtcctctcactatccctcaacccctttctcctttcaatttctgcgccacctttcaatctctcccttcccttaatttcagttcctttctttttctggtagagacagaggagacgcgttttatccgtgaacctaaaactccggtgccagtcacagacttgggaagacagtctttcctttgtgtttaatcacgcggggacacctgcctgattattcagccacatttcagaggtgtctgatcaccatggggacgcctgccttgatccttcaccttggtggcaagcactacctccccgaggcggggcaagtaccctcccaccccttctctccatgtctctaccctctcttttctctgggcttgcttccttcactatgggcaaccttccaccctccattcctccttcttctcccttagcctgtgttctcaaaaacttaaaacctcttcaactcacacctgacctaaaacctaaatgccttattttcttctgcaacaccgcttgaccccaatacaaacttgacagtgtttccaaatagccagaaaatgtcacttttgatttctccatcctacaagatctagataattcttctcgtaaaatgggcaaatggtctgaggtgcctgacgtctaggcattctttttcacatcagtccctttctaatctctgctcccaatgcaactcgtcccaaatctttcttctttctctcctgtctgttccttcagtctccaccccaagctctgagtcctttgaatcctccttttctacagacctatatgacctctctcttcctccccaggctgccccttgccaggccgagccaggtcccacttcttcctcggcttctgctcctccaccctataatccttctatcacctcctctcctcacacccagtccggcttacagtttccttctgtgactagcccttccccacctgcccaacaatttcctcttaaagaggtgtctggagctaaaggcatggtcaaggttattgctcctttttctttatccagcctctcccaaatcagttagtgtttaggctttttttcatcaaatatgaaaacccagcccagtccgtggcttgtttggcaacaacccttagagactttaccttcctagacccagaaaggccagaaggccgtcttattctcaatatgcattttattacccaatctgctcctgacgtttaaaaaaagctccaaaacttaaattccagccctcaaaccccacaacaggatttaattaaccttgccttcaaggtgtacaataattaaaaagaggcagccaagcagcaatgtatttctgagttgcaattacttgcctctgctgtgagagaaaccccagccacatcttcagcacagaagaacttcaaaacgcctaagccacagtggtcaggcattccttcaggacctcctcccccaggatcttgcttcaagtgctggaaatctggccactgggccaaggaatgcctgcagcccgggattcctccttagtcatgtcccatctgtgcgggaccccactggaaatcgaactgtccaacttgcccggcagccactcccagagcccctggaattctggcccaaggctctctgactccttccccgatcttctcggcttagcagctgaagactgacactgcctgattgcctcaaaagcctcctggaccatcacaggcgcttgaggtaactcttacagtggagggtaaggccgtccccttcttaatcaatacagagactacccactccacattaccttcttttcaaggaccgtttcccttgcctccataactgttgtaggtattgatggccaggcttctaaacctcttaaaactccccaactctggtgccaacttagacaatattcttttttttttttttttttttttttggagatggagtctcactctgtcaccgaggctggagtgcagtggcgtgatctcggctcaataatacaagctccgtctcctgggttcacaccattctcccacctcaacctcctgaatagctgggatgacaggcgtccgccaccatgcccagctaattttttgtatttttaatagtgacggggtttcaccatgttagccaggatggtctcgatctcctgacctcgtgatctgcccgccttggcctcccaaagtgctgggattacaggcgtgagccatcgcgcccggccgcttagacaatattcttttgtgcactcctttttagttatccccacgtgcccagttcccttattaggtctaggcattttaactaacttatctgctttcctgactattcctaggctacagccacaactcattgccgcccttttccccagttcaaagcctccttcacatcctccccttgtgtctccccatcttaatccacaagtatgagacacctctattcctaccttggcgaatgatcatgcaccccttaacatcccattaaaacctaatcacccttaccccactcaatgccaatatcccatcccaccgcatgctttaaaaggttaaagcctgttatcactcacttgctacagcatgggcttctaaagcatataaactctccttacaattctcccattttacccatccaaaaaccagacaagtcttacaggttggttcaggatctatgccttatcaaccaaattgttttgcctgtccaccctgtagtgcccaacccgtacactcttgtcctcaatacctccctccacaacccatttttctgttctggatctcaagcatgcttcctttactattcctttgcacccttcatcccagcctctctttgctttcacttggactgaccctgacacccatcagtctcagcaacttacctaggctatactgccacaaggcttcaggaacagcccccattacttcagtcaagccgtttctcatgatttactttctttccatccatctgcttctcactttattcaatattttgacaaccttctactttatagcccctcctacaaatcttcccaaaaggacacccttctgctcctccaacatctgttctcaaaagaatatcgcgtatcctccttcaaagcccaaatttcttcctcatctgttacctatctcggcataattcttaataaaaacacacgttctctccctgctgatcgtgtctggctaatctcccaaaccctaaccccttctacaaagcaacaactcctttccttcctagcatggttaggtactttcacctttggatacctggttttgccatcctgactaaaccgttatataaactcacaaaaagaaacttagctgacctcatagatcctaaatcctttccccactcctctttcctttccttaaaaacagccctagaagctgcttccacactagctctccctaactaatcccaacccttttcattacacacagccgaagtgcagggctgtgcggtcagaattcttacacgagagccgggaccgtgccctgtagcctttctgtccaaacaacttgaccttactgttttaggctggcccccacattattcctgataccacacctgacccccatgaccgtgtctctctgatccacctggcattcactccatttccccatatttcattttttcctgttccccaccctgatcacagtttgtttttgtttttgtttttttgagatggagtcttgctttgtcgcccaggctggagtgcagtggcatgatctcggctcactgcaagctccgcctcccgggttcatgccattccctggcctcagcctcccaagtagctgggactacaggcacctgccatcatgcccggctaattttttttttttgtatttttagtagagacggggtttcaccgtgttagccaggaaggtccctaactcctgaccttgtgatccgcccgcctcggcctcccaaagtgctgggattacaggcgtgagccaccgtgcctggcccacagttggtttattaatggcagttccaccaggcttaatcgccactcaccagctaaggcaggctatgctatagtatcttccacatctgtca

SEQ ID NO: 139 - DNA, 4659 bp, Homo sapiens
ccacaaaagaagtgaaaatggctggttcctgccttaacggatgacattaccttgtgacattccttctcctggacaataagtctccgtagctccccaccaagcaccttgtgacccctgcccctgcccgccagagaacaaccccctttaactgtaattttccactacctacccaaatcctataaaactgcccaccccatctcctttttcagactcagtccacctgcacccaggtgattaaaaagctttattgctcacacaaagcctgtttggttcacatggacgtgcatgatatttggtgctgaagacccgggacaggaggactccttcaggagaccggtcccctgtccttgccctcattccatgaggagatccacctatgacctccgatcctcagatcaaacagcccaaggaacatctcaccaatttcaaattgagtaaacggtcttttcactctcttcttcagcctctctcactacccttcaatctccctgtccttccaattcgggttcctttttctctctagtagagacaaaggagacacattttatccatggacccaaaactgcagcaccggtcatggactcaggaagacagtcttcccttggtgtttaatcactgcagggatgcctgccctgatcattcacccacattccattggtgtctgatcaccggggggacacctgccttggtcattcacccacattcccttggtggcatgtcaattgcagggacacctgctttggctgctcacccatattacagcccagggctgctcaccgcccgcttctccgtgtctctagctttctctttaaacttacctcttcactgtggtcaaccttccaccctgcattcccccttcttctcccttagcctgtgttctcaagaacttaaaacctcttcaactcacacctgaactaaaacctaaatgccttattttcttctgcaatactgctaggccccagtacaaactcgacaattgttctaaatggccagaaaacagcacttttgatttctccatcttacaagacctggatgattttttgtcaaaaaatgggcaaatggtctgaggtgcctgatgtccaggcattctttcacacattggtccctccctagtctctgctcccaaagcgactcatcccaaatctttttttttctctcctgtctgtttccttccatctccaccccaagctctgagtcctttgaatccttcttttctacggactcatctgacctctcccctcctccctgacgctgctcctcgccaggctgagccaggtcccaattcttcctcagcatctgctcccctaccctataatccttctatcacctcccctgctcacacccagtctggcttacagtttcgttctgcaactagccctcctcacctgcccaaaaatttcctcttaaaaaggtggcttgagctgaaggcacagtcaaggttaatgctcctttttctttatctgacctctcccagatcagttagcatttaggctctttttcatcaaatataaaaacccagccccgttcatggcccacttagcagctaccattagatgcttcacagccctagacccagaggggccagaaggccaccttatccttaatatgtattttattacccaatctgctcccaacattagaaaaagctccaaaaatgagattccggccctcaaaccccacaacaggacttaatgaaccttgccttcaaggtgtacaataatagagaagaggcagccaagtggcaacatatttctgagttgcaattactcgcctctgctgtaagagaaaccccagccacatccagcacacaagaacttcaaaacgcctaagccgcagcagacagttgttcctccaggacctcctcccacaggatcttgcttcaagtgctggaaatctggccactgggccaagaaatgtccacagcctgggattcctcctaagccgtgtcccatctttgcgggaccccactggaaatccaactgtcccactcgcccaccaaccacacccagagcccctggaaatctggcccaaggctgtctgactgactccttcccagatcttctcttcttagctgctgaagactgacactgcctgattgcctcagaagcctcctggaccatcacagatgctttaggtaactcttacagtggagggtaagtctgtcccctttttaatcaatacagaggctacccactccacattacctacttttcaagggcctgtttcccttgcctccataactgttgcgggtattgacggccaggctgctagactccttaaaactccccagctttggtgccaactgggacaaaattttttttttttttgagatggagtctctctctattgcccaggctggagtgcagtggcgcgatctcggctcactgcaagctccatctcccaggttcatgccattctcctgcctcagcctcccgagtagctgggactacaggtgcctgccaccacgcctagctaatttttttgtattttttttttagtagagacggggtttcaccgtgttagccaggatattctcgatttcctgacctcgtgatttgcccgcctcggcctcccaaagtgctgggattacaggcatgaaccaccgcccccggcctgggacaacattcttttatgcactcttttttaattatccccacctgcccagtacccttattaggccaagacattttaacccggacaagtcttacaggctggtccaagatcttcgccttatcaaccaaattgtcttgcctatccaccctgtggtgccaaacccatatactctcctatcctcaatacgcccctccacaacccattaatctgttctggatctcaaagatgctttctttactattcctttgcatccttcatcccagcctctcttcggtttcacttggactgaccctgacacccatcagcctcagcaacttacctgggctgtactgccacaaggcttcagggacagcccctattacttcagtcaagccctttctcatgatttactttctttccatcactcccacctactctcccactgaaacttccacctatcaatctcttcccacacaaggcaaatggttcttggactaaggaaaattcctccttccagcctcacaggcccattccattctatcgtcctttcataacctcttctatgtgggttacaagccaccagcccacctcttaaaacctctcatttcctttaagacatttaccttgtatttcactccatccttggctaccttccccttgctcttcagactctcctcccaggccctcttcttgtttgcttatacccagccctgtaaataacagtgaatggttgcttgtagatactcgacgttttttcatgcaccatgaaaattgaacctcctcctctaggaagttaccccatcagtctccattacaacctctgacggctgccaccctagctggatccctaggagtctgggtacaagaaacctttagtactccttctcatctttttactttgcatttccagttttgcctcgcacaaggtctcttcttcctctgtggatcctctacctacatgtgtctacctgctaattggacaggcacatgcacacaagttttccttactcccaaaattcaatttgcaaatgagaccgaagagttccctgttcccctcatgacaccaacagttcactactattttgttttgtttttcttattattaatataaaaagacaggaataggccttgacttactcactgctgaaaaaggaggactctgaatatttccaaatgaagaaggttgttttcacctaaatcaatctggcctggtatatgacaacataaaaaaactcaaggacagagcccaaaaacttgccagtcaagcaaataattacactgaacccccttggacactctctaattggatgtcctaggtcctctcaattcttggtcctttaatacctgtttttctccttctcttattcggaccttgtgacttccatttagtttctcaattcacacaaaactgcatccaggccatcaccaatcattctatacgacaaatgctccttctaacaaccccacaatgtcaccctttaccccaaaatctttcttcagtttactctctcccactctaggttccgacattgctcctaatcctgctcgaagaagccctgagaaacatcacccattatctctccataccacctccaaaaattttcgccaccccaacacttcacctctattttgttttgtcccaacacttcaccactattttgttttgtttttcttattaatataagaagacaggaatgtcaggcctctgagcccaagcctgcacgtgtacatccagatggcctgatgcaactggagaaccacaaaagaagtgaaaatggctggttcctgccttaactgatgacattaccttgtgacattccttctcctggacaatgagtctcagaagctcccccactgagcaccttgtgacccctgcccctgcccacaagagaacaaccccctttaacgtaattttccattacctacccaaatcctataaaactgccccaccccatctccctttgctgactcctttttcggactcagtccacctgcactcaggtgattaaaaagctttattgctcacacaaagcctgtttggtggtctcttcacacggacgcacgtga

SEQ ID NO: 140 - DNA, 7476 bp, Homo sapiens
cttcccccttagcctgtgttcttaaaaacctaaaaccccttcgactaacacctgacctaaaacctaaacatcttattttcttctgtaatactgcttggccccagtacaaactcgacaatagttccaagtggctagagaatggcacttttgatttgtctatcctacaagacctagataatttttgttgaaaaatgggcaaatggtccgaggtgccttatgtccaggcatttttttacaattcattccctccctagtctctgctcccaatgccacttgtcccagattttccttctttctctcccatccactcctcttgtctccaccccaaactcagagtcctctgaatcctccttttccactgacccctcttacctctcttctcccccggctgctccttgccaggctgaatcaggtcccaattcttccatagcctccgcttccccaccctataacccttctattaccttccctcctcacacctggtctggcttacagtttcgttccgtgactaggtctcccccacctgcccaacaatttcctcttagagaggtggctggagctgaaggcatagtcagggtacatgtgcctttttctctatcagacctttcccaaatcagtcagcattttggctctttctcatcagaccccaataaatatatacaggaattccaatatctaactcagtccttcactttaacctggagtgacttaaatgtcatcctgacctctaccctctccccagataaatgagaaagagtttattctctagcccagtcctatgcagacacctgccggcttcataagccaggcctccaagagggcactagggcagttccccgagaggatccccattggcaataccacacagactccccaggtatagctaggtgagattacatggtctcctgcctagtctaggggctcaaaaaggcagcatacaaagctgttaattatgacaagctaaaggaaactacccaacgtgaagatgaaaacccagcccagttcatggcccacttagcagctacccttagatgctttacagccttagacccagaggggccagaaggccgccttatccttaacatgcattttatgacccaatccactcctgacattagaaaaaaactccaaaagttggattccggccctcaaaccccacaataggatttaatcaacctcaccttcaaggtgttcaataacagagaagaagccgccaagtggcaacgtatctctcagttatagctacttgcctccactgtaagacaacccacaaccacgtctccagcatacaaaaccttcggaacatccaagccacagctcccaggggctccttcaaaacctccctgtggaccttgcttcaaatgccaaaagcctggccactgggcctcggagtgccagcagcccaggattcctcctaagtcgggccctgtctgtgcaggcccccactggaagtcagactgtctgactcacatcgctgccactcctaaagctcctggagctcaaacccaacattccttggccgactccttcccagatctcctcggcttagcagctgaatgtcgatgctgcctgatcgcctcagaagccccctggaccatcacggatgccgagctttgggtaactcttacagtggatggtaagtccataacctgtttaatcgatacgggagctaccccctccacattaccttcttttcaagggcctgtttcccttgcccccgtaactgttgtgggtattgacggccaggcttctagaccccttaaaagtccccaactctggtgccaacttggataacattcttttatgcactcttttttagttatccccacctgcccagttcccttattaggccgagacattttaactaaattatctgcttcccttgcttccctgactattcctggactacagtcacacctcattgctgcccttttacctgattcaaggcctcctttgaatcctcctctcatgtctccctaccttaatccacaagtatgggatacctctactccctccttggtgactgatcaggtaccccttaccatcccattaaaacctagtcactcttaccccgctcaatgccagtaccccatcccacaacaggctttaagaggactaaagcctgttatcactcacctgttacagcatggctttttagagcctataaattctccttacaactcccctatcctaccagtccagaagctggacaaatcttacatgttggttcaggatcttcaccttattacccaaattgtcttacctgtccatactgtggtgccaaacccatatactctcctatcctcaatacctccctccacaactcattattccatcctcgacctcaaagatgctttcttcactattcctttgtacccctcatcctaaccttttttcgctttcacatggactgaccctgacacccaccaatctcagcaactcacctggactgtactgccacaaggtttcagagacagcccccattactttagtcaagctctttctcatgatctactttctttccatccatctgtttctcaccttattcaatatatggacgaccttctcctctgcagctcctcttatttatttattttttttgagatggagtcttgctctgttgcccaggctggagtgcagtggcaagatctcggctcactgcaagctccacctcccaggttcaggccattctcctgccgcagcctcccgagtagctgggactacaggtgcccgccaccatgcccggctactttttttgtatttttagtagagacagggtttcaccatgttagccaggatggtctcgatctcctgaccttgtgatctgcctgtctcggcctcccaaagtgctgggattacaggcgtgagccaccacgcctggcctgcagcccttcttatgaatcttcccaaaaagataccctcctgcttcttcaacatatattctcaaaggggtgtcatatatccccctctaaagcccaaatttcttccccatccattacctatcttggcagagtccttcatcaaagcacacatactctccctgctaactgtgtacagctaatctccaaaaactccaaccccttctacaaagcaacaactcctttccttcctaggcatggttggatactttcgcctttggataccaggttttgccatcctaactaaaccactatataaactcacaaagggaaacctgactgaccccatagacctaagtcctttccccactcttcttttcattccttaaagacaaccctagaaacagtccccacattagcactccctaactcgtcccaatccttcttattacatatagctgaaatacaaggctgtgcgttcagagtttttacacaggatccaggcccatgacctgtagccttcctgtccaaacaacttaacctcacagttctaggctggccctcatgtctacgtgcagcagcagctgccgcttcaatacttctggaggacctcaagctcacaaaccatgccccacttactctctacagctctcataactttcaacatctattttcctactcacacttggtgtatatactttccaccccctaactcctccaactctactcacaattcattgaaactcccacaattaccattgttcctggcacagacttcaccccatcctctcaccttatacccagcaccaaacctgaatctcatgattgtatctccctaatccatgtggcatcctccccatttccccatatttccctctttcctgttcctaatccagaccacacttggtttattgatggtagttcttcaaggcccaatcatcagtcaccagcaagggcaggctatgctgtagtgtcttccacatctgtcattgaagctactgccttgcccccttccactacctctcaacaagccaaactcattgctttaaactgggcccacacccttgcaaagggactatgtgtcaatatctacactgattccaagtatgccttccacatcctacatcaccatgctgttatatgggcagaaagaggttttctcactacacaagggtcctccatcatcaactgcctttataaaaatcctccttaaggctgctttactgcccaaagaagctgaagtcattcactgcaaggggcatcagaggtcaccagatcccattgcttgaggcaacacttatgctgatatgcagcaaaagaagcagctagtattcccacatctgtccctcacagccagttttcttccttctcatctatcactcccacctattctcccactgaaactattacctattaatccattcctactcatgaaactattacctattaatccattcctactcaaggcaaatggttcttggatcaaggaaaattcctccttcctgcctcacaggctcattctatcttatcatcctttcagaacctctttcatgtgggttacaagccaatggcccatctcttagaacctctcatttcttttccatcatggaaatccatcctcaaggaaattacttctcagtgttccatctgctactctaccaccactcagggatatctcacgccccctccctttcctacacatcaagctagaggatttgccccaacccaggactggcagactgactttacccatatgccccaagtcaaaaactaaggtaccttttggtctgggtagatacattcactggatgggtagaggccttttccacagggtctgagaaggccaccacagtcgtttcttcccttctgtcagacataattcctcggtttggccttctgacctctatatagtctgataatggaccggccttcattagtcaggtcacgtaagcagtctcccaggctctcagcatccagtggaaacttcatacccccttaccatccttcatctttgggaaaggtagaaagaactaatggtcttttaaaaacacacctcaccaagctcagcctccaacttaaaaaagactggacagcacttttaccatttgccctccttagaattagagcctatcctcaagaagctacaggatatagtccatttgaactttcatacggatgtactttcttgctgggccccaacctcttgacagacaccagccctctaggcgactatcttctggtactccagcaggctagacaggaaattctccaggctgctaatcttttcttgcctactccagattcccagcaatatgaagacaccctagctggatgatcagttcctgttaagaatatgacccctcaaaccttgatggactggaccctgcttagtcatctatagtaccccaactgctgtctgcctgcaggaccctctgtattgggttcaccattccagaataaagctgtgtctgccagccagccagcctgatctctcctcttcctcctggaaatcgcaagtactctcccctgcttcccttaaactcacttgcatttctgaagaacagtaataacccttatgagcctaatatatcccttcattctattaggtctattcatccttaccctactttttgcaacagggctttacacagtcacccccactacttggactgtgccccaaaaacttgtcatccctactatcttctgtctagtcatactcctattcaccattctcaactactcataaatgccctgcccttgtttacactgccagtttacacttttcctccaaaccatcataactgatatctcctggttttacctcaaaccgccacccttaactctctctgggagtggatagaagctcttcagtggcaaggtacactccaattcctctatcctgataaagtccttttttttttttttttttttacttttctacttactcttatccttgaccccattctccagtcactatctacctctccctagttacctccagcatactatcaatctcacccactctctcctcactgcctccaatccttctctagcaaagaattgttggctatgtgtttccctttcttcctgctcttacaagtccccgctctacaggccgactgggctacctctcctgtctccctgcacctccaaacctcctttacctcatctttaccctcctgaggaacttctttactttctagacagatttggtgagaactccccagacatttcacaccaacaagctgccacacttctccgcatctacttatggtacctttctccttatgtcaagtccacccccccccaaatttggacccctaaccacacaaacaactatccctgttgctgctcctttttgcatctcctgaccacagcctactggaatccctttaggcaaccttccaccgtccaaatgttcctttactctttatctccagaacccagccacacacactaccaaacagatgggagcattccaacttcgcattgctgataagccctctatcattattgacaaactaaaaaacattggcagtcactattgtttaggaagacacctaccctgcatctcactccatccttggctaccctccgcttgctcatctgactctcctcctgactcctcctcttgcttgcttatacccagccccatcaatagcagtgaaaggttactcatagatactatgctctttctcatataccatgagaaccaaacctttcatctacacaattgcaccatcaatccccattacaacctctaacagctgctgtccttgctggatctctaggatttggggtgcaggactcctctttcagtacaccctctcaccttttcactttacatttccagttctgcctgacacaaggtttcttctttttatgtggctcttccacctacatgtgcctacctgccagctagatgggcacatgtactctagtcttccttactcccaaaatccagtttgtagatgggaatgaacaactgcctgtccccctcatgacaccaacatgacaaaaaagagtcatctcactaatccctttgcttgtgggtctaggactttctgcctccactcttgcacttggaactggaatagcaggcatctcaacctctgtcacagcattccgcagcctctctaatgacttctctgctagcattacagatatatcacaagctttatctgtcctccaagcccaggttgactctttagctgcagttgtcctgcagaaccgccaaggcctcaatttactcactgctgaaaaaggaggactctgtatatttcttaatgaagagtgttgtttttacttaaatcaatctggcctggcatatggtaacatcaaaaaactcaaagacagagctcaaaaactcactaatcaggcaactaattatgctggacccacctggtcactctctaactgggtatcctggcttgttccaatcattagtcctgtaatacctatcttcctccatctcttattcgggccttttgtcttccgattaatctctcaattcctacaaaactgcatccaggctatcactaatcactctatatgacaagtgctgcttttaacaagcccacaatatcaccccttaccccaaaatcttacttcagtctaa

SEQ ID NO: 141 - DNA, 6821 bp, Homo sapiens
gtcaggcctctgagcccaagctaagccatcatatcccctgtgacctgcacatacacatccagatggccagctcctgccttaactgatgacattccaccacgaaagaaatgaaaatggcctgttcctgccttaactgataacattatcttgtgaaattccttctcctggctcatcctggctcaaaagctcccttactgagcaccttgtacccccactcctgcctgccagagaacaacccccctttgactgtaattttcctttacctacccaaatcttataaaacggccccacccctatctccctttgctgactctcttttaggactcagcccacctgcacccaggtgattaaaagctttattgcaccaaacacaaagcctgtttggtggtctcttcacacggacgcaagtgaaatttggtgccgtgattcggatcaggggacctcccttgggaaatcaatcccctgtcctcctgctctttgttccatgaaaaagatccacctacgacctcgggtcctcagacccaccagtccaaggaacatctcaccaattttaaatcgggtaagcggcctcttcttactctcttctccaacctctctcactatccctcaaccactttctcctttcaatcttgtcgccacccttcaatctctcccttctcttaatttcaattcctttcattttctggtagagacaaaggagacacattttatccatggacccaaaactctggcgccggtcacggactcaggaaggcagccttcccttggtgtttaatcattgcagggacacctctctgattattaaaccacgtttcagaggtgtctgaccatgcagggacgcctgccttggtccttcacccttagcggcaagtcccgcttttctgggggaggggcaagaaccctgaccccttctctccctgtctctactgcttctctgcttttctggggggcaagaaccccccaatcccttatttccgtgccccgacctcttatctctgcaccctgatcccttatttctgtgcccccacctcttatctctgagccccaaccccttatttctgtgccccaaccccttttctgcttttctggaaggcaagaaccccccaaccccttctctccatgtctctaacccttctctgcttttctggagagcaagaacccccccccccaaccccttctctccgtgtctctaccccttctctgcttttctggagggcaagaaccccccccaaccccttccctccatgtctctactctctcttttttctgggcttgcctccttcactatgggcaaccttccaccctccattcctccctcttctcccttagcctgtgttctcaagaacttaaaacctcttcaactcacacctgacctaaaacctaaatgacttattttcttctgcaatgctgcttgaccccaatataaactcgacagtggttccaaacagccagaaaatggcacttttgatttttccatcctacaagatctagataattcttgtcgtaaaatgggcattcataaaatgggcaaacggtctgaggtgcctgatgtccaagcattcttttacatattgttccctccctactctctgttcccaatgtgactggtcccaaatcttccttctttccctcctgtttgttctctcagtcccaactccaagcattgctgagtctttctaatcttccttttctacagacccatctgacctctcccctcctccccaggctgctcctcacaattcttcctcagcctctgctccccatccctataatccttttatcacctcccctcctcacacccggtccagcttacagttttgttctgagactagccctcccccacctgcccagcaatttcctcttaaaaaggtggctgaagctaaaggcatagtcaaggttaatgctcctttttctttatcagacctctcccaaatcagttagcgtttaggctctttcatcaaatatgaaaaacccagcccagttcacggctcatttggcagcaaccctgagacgctttacagtcctggaccctaaaaggtcaaaaggccgtcttattctcaatatacattttattacccaatctactcctgacattaaataaaactccaaaaattaaattctggccctcaaaccccacaacaagacttaatctcaccttcaaggtgtacaataatagagtagaggcagccaagtagcaatgtatttctgagttgcaattccttgcctccactatgagacaaaccccagccacatctccagcacacaagaactccaaatgcccgaaccgcagctgccaggggttcctccagaatctcctcccccaggagcttgctacaagtgccagaaatctggccactgggccaaggaatgcccacagcccaggattcctcctaagctgcatcccatctgtgcgggaccccactgaaaatcagactgttcaactcacctggcagccactcccagagaccctggaactctggcccaaggctctctgactgactccttcccagatcttctcggcttagcagctgaagactgacactgcccgattgccttggaagcctacagaaccatcacagatgctctgggtaacactcacagtggagggtaagtccgtccccttcttaatcaatacggaggctacccactccacattgccttcttttcaagggcctgtttcccttacctctgtaactgctgtaggtattgatggccaggcttctaaacctcttaaaactccccaactctggtgccaacttagacaatacttttttaagccctcctttttagttatccccacctgcccagttcccttattaggctgagacactttaactaaattatctgcttccctgactattcctggactatagccacatctcattgccgcccttcttcccaatccaaaacctcctttgcgtcctcttcttgtatccccccaccttaacccacaagtgtgggatacttctactccctccttggctaccgatcatgcaccccttatcatctcattaaaacctaatcacccttactccactcaatgcctatatcccatcccgcagcacgctttaaaaagattaaagcctgttatcactcgcctgctacagcatggccttttaaagcctataaactctccttacaattcccccatttcacctgtcctagaaccagagaagccttacaggttagttcaggatctgagccttatcaaccaaattgttttgcctatccaccccatggtgccaaacccatatactctcctatcctcaatacctccctccacaacctattattctgttctgttctggatctcaaacatgctttctttactattcctttgcacccttcatcccagcctctcttcgctttcacttagactgaccctgacacccatcaggctcagcaaattacctgggctgtactgccgcaagacttcacagatagcccccattacttcagtcaagcccaaatttcatcctcatctgttacctctctcggcataattctcataaaacacatgtgctctccctgctgatcgtgtccaactaatctcccaatcctcaatctcttctacaaaataacaactcctttccttcctgggcatggttagatactgtcgactttagatatctggttttgccgtcctaacaaaaccattatataaactcacaaaaggaaacctagttgaccccatagatcctaaatcctttccccactcctctttctgttccttgaagacagctttagagactgcccccaccctcgctctccctgactcaccccaacccttttcattacccatagccgaagtgcagggctgtgcagtcagaattcttacacaaggaccacgaccacaccctgtagactttttatctaaacaacttgaccttactgttttgcccagccctcaagtctgcatgtggcagctgccactgctctaacacttttagaggcccttaaaatcacaaactatcctcaactgactctctacagttctcataactttcaaaatctatttacttcctcacacctgacacatatactgtctgctcccaggctccttcagctgtactcactctttgttgagtctcccacaattaccactgttcctggccgacttcaatccggcctcccacattattcctgataccacacctgacccccatgactgtatctctctgatccacctgacattcactccatttccccatattctttcatgttccttaccctgaacacacttggtttattgatggcagttccaccaggcctaatcgccactcaccagcaaaggcaggctatgctatagtatcttccacatctatcattgaggctactgctctgtctccctccactacctctcagcaagccgaactcattgccttaagtcaagccctcactcttgcaaaaggactaaacgtcaatatttatactgactctaaatatgccttccatatcctgcaccaccatgcaagaggtttcctcactacaccacggtcctctatcattaatgcctctttaataaaaatgcttctcaaagctgctttacttccaaaggaagctagggtcattcactgcaaaggccatcaaagggcatcagatcccagcactcaggacaatgcttatgctgataagatagctaaaaaagcagctagcattccaacttatatccctcactttcagtttttctccttcatatcagtcactctcacctactcccccgctgaaacttccacctatcaatctcttcccacacaaggcaaatggttcttagaccaagaaaaatatctccttccagcctcacaggcccattctattctgtcatcatttcataacctcttccatgtaagttacaagctgctagcccatctcttggaacctctcatttcctttccatcctataagtacatcctcaaggaaatcacttctcagtgttccatttgctattctactacccctcaggaattgttcaggcctcctccctttcctacacatcaagctcggggatttgcccctgcccaggactggcaaattgactttactcacatgccccgagtcaggaaactaaaatacctcttagtctgggtagacgctttcactggatgggtaggcctttcctacagggtctgagaaggccaccgctgtcatttcttcccttctctcagacataattcctcggtttggccttcccacctctatacagtccgatagcagaccagcctttattagtcaaatcagccaagcagtttttcaggctcttggtattcagtgaaacctttatatcccttatggtcctcggtcttcaggaaagtagaacggactaatggtcttttaaaaacacacctcaccaagctcagccaccaacttagaaaggactggacaatacttttaccactttcccttctcagaattcaggcctgtcctcagaatgctacagggtacagcccatttgagctcctgtatggacgctcctttttattaagccccagtctcattccagacaccagaccaacttggactgtgccccagaaaacttgtcatccctactatcttctgtctagtcatactcctattcaccgttctcaactactcatacatgccctgctcttgtttacactgctggtttacactgtttcttcaagccatcacagctgatatctcctggtgctatccccaaacagccactcttaacttttttttttttttttttttttttttttttttttttgagacggagtctcgctctgtcgcccaggctggactgcggactgcagtggcgcaatctcggctcactgcaagctccgcttcccgggttcacgccattctgcctcagcctcccgagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtaagccaccacgcccggccaactcttaaagtaaataaataatctttgctggcaggactatgctgaatctccttaagcactctctaattagatatcctgggtcctcccaattctcagacctttaatacctgtttttctcctcttattccatttagtttttcaattcacacaaaaccgtatccaggccatcaccaataattctaaatgacaaatgtttcttctaacagtcccacaatatcacctcttaccacaaaatcttccttcagcttaatctctcccactctaggttcccacaccaccccaatcccgtttgaagcagccttgagaaacattgcccattctctctccataccatccccccaaattttcgccgtctcaacactttaccactatttcattttatttttcttattaatataagaagacaggaatgtcaggcctctgagcccaagctaagccatcatatcccctgcgacctgcacgtacacatccagatggccagctcctgccttaactgatgacattccaccacaaaagaaatgaaaatggcctgttcctgccttaactgattacattatcttgtgaaattccttctcctggctcatcccagctcaaaagttcccctactgagcaccttgtgacccccactcctgcctgccagagaacaacccccctttgactgtaattttcctttacctacccaaatcttataaaacagccccacccttatctcccttcgctgactctcttttcggactcagcccgcctgtacccaggtgattaaaagctttattgctcacaaaaagcctgtttggtggtcttttcaca

SEQ ID NO: 142 - DNA, 950 bp, Homo sapiens
gtggggaaaagaaagatcagattgttactgtgtctgtgtagaaagaagtagacacaggagactccattttattctgtactaagaaaaattcttctgccttgagatgctgttaatctgtaaccttaccccgtgctccctgagacatgtgctgggtcaactcagggttaaatggattaagggcggtgcaggatgtgctttgttaaacagatgcttgaaggcagcatgctccttgagagtcatcaccactccctaatctcaagtacccagggacacaaacactgcggaagaccgcagggacctctgcctaggaaagccaggtattgtccaaggtttctccccatgtgatagtctgaaatatggcctcgtgggaagggaaagacctgacagtcccccagcccgacacccgtaaagggtctgtgctgaggaggattagtaaaagaggaaggaacgcctctttgcagttgagacaagaggaaggcatctgtctcctgcccgtccctgggcaatggaatgtctcgtgtaaaacccgattgtatgttccatctactgagatagggggaaaccgccttagggctggaggtgggacacgcgggcagcaatattgctcttcaaggcattgagatgtttatgtgtatgcacatcaaaagcaaagcacttaattctttaccttgtttatgatgcagagacctttgttcacgtgtttacctgctgaccttctctccactattatcctatgaccctgccacatccccctctccgagaaacacccaataatgatcaataaatactaagggaactcagaggccggtgggatcctccgtgtgctgaacgcggtcccctgggcccccttttctctttctctatactttgtctctatgtctcttttccaagtctctcattccacctaacgagaaacactcccaggtgtggaggggcaacccaccccttca

SEQ ID NO: 143 - DNA, 583 bp, Homo sapiens
aagtcccactgccctgggggacaaaggtcctctgagtcagaagccactaaccagatgatccagcagcaggactgagggtaccagggcaagcaccagcccatgccatcacccacacagagccccaggtatgcttgaccattgagggccaggaggttaactgtttcctggacactggtgcggtcttctcagtcttactctcctgtcctggacaattgtcctccagatctgtcactatctgaggggtcctaggacaggcagtcacttgatacttctcccagccactaagttgtgactggggaaatttactcttttcacatgcctttctaattacgcccgaaagccccactcctttgttagggagagacattctagcaaaagcaggggccattatacactagaattagaaggaaaaaggttaaatatacagactctaagcatgcttacctagtcctccaagcccacgcagcaatatggagagaaagggaattcctaacttccgagggaacacctatcaaacatgaggaagccattaggccccccaaattctctttacctctgaatctacgtcctctgatccctgcct

SEQ ID NO: 144 - DNA, 1847 bp, Homo sapiens
actttcttgctcagccccaacctcttcccagacaccagccctctaggcgactatcttccagtcctccagcaggctagataggaaattcgctaggttgctaatcttctcttgcctactccagattcccagccatataaagacacgctagtgggaatcagttcttgttaagaatccgatccctcaaactctacaacctcattggaccagaccctacttagtcatctataataccccaactgcctccacctgcaggaccctccccactgggtttaccattccagaataaagctgtgtccatcagacagccagcttgatctctcctcttcctcctagaagtcgcaagtacttatccctacttcccttaaagtcacccacatttctaaagaacagtagtgacccttatgagcctaatacatcctttcattttgttaggtctattcatccttaccctactctttgcaatagtgctttatgcagtcacccctactacttaaactgcatcctaaaaacttttcatccttgctgtcttctgtctagtcatactcttattcttcgttctcacttatccatgagtgcccacccttgtctacactactggcttatattttttctccaaaccatcatagctggtcctggtcttatcccctaaccaccactcttaactccctcttacagtggataaatgacctttgctgaaaaaacacactccaattctttcccctactttacatttctagttttgccttacacaaggtctcttcttcctctgtggctcctctacctacatgtgtctacctgttaattagacaggcacatgtacactagttttccttacccctaaaaatcagtttgcaaatattaccgaacagcttcctgttcccctcatgacaccaatacttcaccactatcttgttttgtttttcttattattaatacaataagacgggaataggtcttgacttactgctgaaaaaggaggactctgtatatttttaaatgaaaagtgttgtttttacctaaatcaatctggcatggtacatggcaacataaaaaaaaactcaaagatagggcccaaaaactcaccaaccaagcaaataatcatgctgaacctccttgggcactctctaattggatgtcctgggtcctcccaactcttagtcctctaatacctgtttttctccttctcttattcagtccttgtgtcttccgtttagtttctcaattcatacaaaaccgtatcgaggccatcacctatcattctacacaacaaatgctctttctaacaaccccacaatatcaccccttaccacaaaatctttcttcagcttaatctctcccactctaggttcccataccgcccctaatcccactcaaagcagccctgagaaacatcgcccattatctcttcataccacctccaaaaattttcaccaccctaacacttcaccactatctggttttgcttttcttattaatataagacaggaatgtcaggcctttgagcccaagcctgcacgtatacatccagatggcctgaagcaactgaagaatcacaaaagaagtgaaaatggccgattcctgccttaactgatgatattaccttgtgaaattccttctcctggctcagaagctccccgactaagcaccttgtgacccccacccctgcctacaggagaacaactccctttgactgtaattttccactacctacccaaatcctataaaactgccccacccctaactccctttgctgactctcctttcagactcacctgcacccaggtgattaaaaagctttattactcacacaaagcctgttggtggtctcttcacacggatgcgcaaga

SEQ ID NO: 145 - DNA, 90 bp, Homo sapiens
tcaccaccatcttggaagcagcacaccgccatcttggaagtggcctgccaccatcttgggagctctgggagcaaggatcccccggtaaca

SEQ ID NO: 146 - DNA, 582 bp, Homo sapiens
agggaaagacctgaccatcccccagccggacacccataaagggtctgtgctgaggaggattagtgaaagaggagggcatctttgcagttgaggtaagaggaaggcatctgtctcctgctcatccctgggcaatggaatgtctccgtgtaaaacccgattgtatgttctatttactgagataggtgaaaactgccttaaggctggaggtgagacacgctggcagcaatactgctctttaatgcaccgagatgtttgcgtacgcgcacaccaaagcacagcaccttttcttaaccttgtttatgacagacctttgttcacatgttttcctgctgaccctctccccactattaccctactgtcctgccacatccccctctctgagatggtaaaaataatgatcaataaatactgagggaactcagagaccagtgctggcgcaggtcctccatatgctgagcgctggtcccctgggcccacttttctttctgtatactttgtctctgtgtctttttcttttctcagtctttcatcccacctgaggagaaacgcccacaggtgtggaggcgcaggccccccccttca

SEQ ID NO: 147 - DNA, 9137 bp, Homo sapiens
gtggggaacagcaagagagatcagattgttactgtgtctgtgtagaaagaagtaggcataggagactccattttgttatgtactaagaaaaattcttctgccttgagattctgtgaccttacccccaaccccgtgctctctgaaacatgtgctgtgtcaactcagagttgaatggattaagggcggtgcaagatgtgctttgttaaacagatgcttgaaggcagcatgctccttaagagtcatcaccactccctaatctcaagtacccaaggacacaaaaactgcagaaggccgcagggacctctgcctaggaaagccaggtattgtccaaggtttctccccatgtgatagtctgaaatatggcctcatgggaagggaaagacctgactgtcccccagcccgacacccgtaaagggtctgtgctgaggaggattagtaaaagaggaaagaatgcctcttgcagttgagacaagaggaaggcatctgtctcctgcctgtccctaggcaatggaatgtctcagtataaaacctgattgtatgctccatctactgagataaggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgaggaacacccacaggtgtggaggggcaacccacccctacatctggcgcccaacgtggggcttttctctagggtgaaggtacgctcgagcgtggtcattgaggacaagtcgacgagagatcccaagtacgtctacagtcagccttacggtaagcttgtgtgctcagaagaagctaaggtgataatggggcaaactaaaagtaaaattaaaagtaaatatgcctctcatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaagaggtgatataacctgaaacgttaaaattagaaggaaaaggtccagaattagtggggccatcagagtctaaaccatgaggcacaagtcctcttccagcaggtcaggtgcctgtaacattacaacctcaaatgcaggttaaagaaaataagacccaaccgccagaagcttatcaatactggccgccggctgaacttcagtatcggccacccccagaaagtcagtatggatatccaggaatgcccccagcaccacagggcagggcgccataccctcagctgcccactaggagacttaatcctatggcaccacctagtagacagggtagtgaattacatgaaattattgataaatcaagaaaggaaggagatactgaggcgtggcaattcccagtaacattagaaccgatgccaactggagaaggagcccaagagggagagcctcccacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatagagtacaagaacaggtccgaagaaatagggctgccaatcctccagttaacatagatgcagatcaactattaggaacaggtcaaaattggagtactattagtcaacaagcattaatgcaaaatgaggccattgagcaagttagagctatctgccttagagcctaggaaaaaatccaagacccaggaagcgcctgcccctcatttaatacagtaagacaaggttcgaaagagccctaccctgattttgtggcaaggctccaagatgttgctcaaaagtcaattgccgatgaaaaagcccgtaaggtcatagtggagttgatggcatatgaaaacgccaatcctaagtgtcaatcagccattaagccattaaaaggaaaggttcctacaggatcagatgtaatctcagaatatgtaaaagcctgtgatggaatcggaggagatatgcataaagctatgcttatggctcaagcaataacaggagttgttttaggaggacaagttagaacatttagaagaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcattctaaatttgataaaaataggcaaccattgtcaggaaacgagcaaagaggccagcctcaggccccacaacaaactggggcattcccaattcagccatttgttcctcaaagttttcagggacaacaaccccccctgtcccaagtgtttcaaggaataagccagttaccacaatacaacaattgtcccccgccacaagcagcagtgcagcagtagatttatgtactatacaagcagtctctctgcttccaagggagtccccacaaaaaatccccacaggggtatatggcccactgcctgaggggactgtaggactaatcttaggaagatcaagtctaaatctaaaaggagttcaaattcatattagtgtagttgattcagactataaaggcgaaattcaattggttattagctcttcaattccttgaggtgccagtccaggagacaggattgctcaattattactcctgccatatattaagggtggaaatagtgaaataaaaagaataggagggtttagaagcactgatccaacaggaaaggctgcatattaggcaagtcaggtctcagagaacagacctgtgtgtaaggccattattcaaggaaaacagtttgaaaggttagtagacactggagcagatgtctccatcattgctttaaatcagtggccaaaaaattggcctaaacaaaaggctgttacaggacttgttggcataggcacagcctcagaagtgtatcaaagtactgagattttacattgcttagggccagataatcaagaaagtactgttcagccaatgattacttcaattcctcttaatctgtgaggttgagatttattacaacaatggggtgcagaaatcaccatgcccgctccattatatagccccacgagtcaaaaaatcatgaccaagataggatatataccaggaaaaggactaaggaaaaatgaagatggcattaaagttccagttgaggctaaaataaatcaaaaaagagaaggaatagggtatcctttttaggggcggccactgtagagcctcctaaacccataccattaacttggaaaacagaaaaattggtgtaggtaaatcagtggccgctaccaaaacaaaaactggaggctttacatttattagcaaatgaacagttagaaaaaggtcatattgagccttcattcttgccttagaattctcctgtgtttgtaattcagaagaaatcaggcaaatggcgtatgttaactgacttaaaggccataaatgccgtaattcaacccatgaggcctctccaacctaggttgccctctccggccatgatcccaaaagactggcctttaattataattgatctaaaggattgcttttttaccatccctctggtggagcaagattgtgaaaaatttgcctttactataccagccataaataataaagaaccagccaccaggtttcagtggaaagtgttacctcaaggaatgcttaatagtccaactatttgtcagacttttgtaggtcgagctcttcaaccagttaaagaaaagttttcagactgttatattattcattatattgatgatattttatgtgctgcagaaacgaaagataaattaattgactgttatacatttctgcaagcagaagttgccaatgcaggtctggcaatagcatctgataagatccaaacctctactccttttcattatttaagaatgcagatagaaaatagaaaaattaagccacaaaaaatagaaataagaaaagacacattaaaaacactaaatgattttcaaaaattgctaggagatattaattagattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccatcttttaatttttgccactgcacattctccaacaggcatcattattcaaaatactgatcttgtggagtggtcattccttcctcacagtacagttaagacttttacattgtacttggatcaaatagctacattaattggtcagacaagattatgaataataaaattatgtggaaatgacccagacaaaatagttgtccctttaaccaaggaacaagttagacaagcctttatcaattctggtgcatggcagattggtcttgctaattttgtaggaattattgataatcattacccaaaaacaaaaatcttccagttcttaaaattgactacttggattctacctaaaattaccagatgtgaacctttagaaaatgctctaacagtatttactgatggttccagcaatggaaaagcagcttacacaaggccgaaagaacgagtaatcaaaactccatatcaaccgactcaaagagcaaagttggttgcagtcattacagtgttacaagattttgaccaacctatcaatattatatcagattctgcatatgtagtacaggttacaaaggatgttaagacagctctaattaaatatagcatggatgatcagttaaaccagctattcaatttattacaacaaattgtaagaaaaagaaatttcccattttatattactcatattcgagcacacactaatttaccaaggcctttgactaaagcaaatgaacaagctgacttactggtatcatctgcattcataaaagcacaagaacttcatgctttgactcatgtaaatgcagcaggattaaaaaacaaatttgatgtcacatagaaacaggcaaaagatattgtacaacattgcacccagtgtcaaatcttacacctgcccacccaagaggcaggagttaatcccagaagtctgtgtcctaatgcattatggcaaatggatgtcacgcatgttccttcatttggaagattatcatatgttcatgtaacagttgatacttattcacatttcatataggcaacttgccaaacaggagaaaatacttcccatgttaaaaaacatttattgtcttattttgctgtaataggagttccagaaaaaatcaaaactgacaatggacaaagatattgtagtaaagctttccaaaagttcttaagtcagtggaaaatttcacatacaacaagaattccttataattcccaaggacaggccatagttgaaagaactaatagaacactcaaaactcaattagttaaacaaaaagaagggggagacagtaaggagtgtaccactcctcagatgcaacttaatctagcactctatactttacattttttaaacatttatagaaattagactactacttctgcagaacaacatcttactgctaaaaagaacagcccacatgaaggaaaactaatttggtggaaagataataaaaataagacatgggaaataaggaaggtgataatgtgggggagaggttttgcttgtgtttcaccaggagaaaatcagcttcctgtttggatacccactagacatttgaagttctacaatgaactcatcagagatgcaaagaaaagcacatccgtggagacggagacaccacaatcgagcaccgttgactcacaagatgaacaaaatggtgacgtcagaagaagagatgaagttgccatccaccaagaaggcagagccaccgacttgggcacaactaaagaagctgacacagttagctacaaaatatctagagaacacaaaggtgacacaaaccccagagagtatgctgcttgcagccttgatgattgtatcaatggtggtaagtctccctatgcctgcaggagcagctgcagctaactatacctactgggcctaagtgcctttcccgcccttaatttgggcagtcacatggatggataatcctatagaagtatatgttaatgatagtgtatgggtacctggccccacagatgatcgctgccctgccaaacctgaggaagaaaggatgatgataaatatttccattgggtatcgttatcctcctatttgcctagggagagcaccaggatgtttaatgcctgcagtccaaaattggttagtagaagtacctactgtcagtcccatcagtagattcacttatcacatggtaagcgggatgtcactcaggccacaggtaaattatttacaagacttttcttatcaaagatcattaaaatttagacctaaaaggaaaccttgcctcaaggaaattcccaaagaatcaaaaaatacagaagttttagtttaggaagaatgtgtggccaatagtgcggtgatattacaaaacaatgaattcggaactattatagattaggcacctcgaggtcaattctaccacaattgctcaggacaaactcagccgtgtccaagtgcacaagtgagtccagctgttgatagcgacttaacagaaagtttagacaaacataagcataaaaaattgcagtctttctacccttaggaatgaggagaaaaaggaatctctaccccaagaccaaaaataataagtcctgtttctggtcctgaacatccagaattatggaggcttactgtggcctcacaccacattagaatttggtctggaaatcaaactttagaaacaagagatcataagccattttatactatcgacctaaattccagtctaacacttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctagtgagagcaagagagggcgtgtggatccctgtgtccatggaccgaccgtaggaggcctcgccatgcgtctatattttgactgaagtattaaaaggtgttttaaatagatccaaaagattcatttttactttaattgcagtgattataggattaattgcagtcacagctacggctgctgtagcagaagttgcattgcactcttctgttcagtcagtaaactttgttaatgattggcaaaaaaattctacaagattgtggaattcacaatctagtattgatcaaaaattggcaaatcaaattaatgatcttaaaaaaactgtcatttggataggagacagactcatgagcttagaacatcgtttcacgttacaatgtgactggaatacgtcagatttttgtattacaccccaaatttataatgagtctgagcatcactaggacatagttagacgccatctacaaggaagagaagataatctcactttagacatttccaaattaaaagaacaaatttttgaagcatcaaaagcccatttaaatttagtgccaggaactgaggcaattgcaggagttgctgatggcctcgcaaatcttaaccctgtcacttaagaccatcggaagtactacaattataaatctcatattaatccttgtgtgcctgttttgtctgttgttagtctgcagctgtacccaacagctccgaagagacagcgaccatcgagaacaggccatgatgacgatagtggttttgtcgaaaagaaaagggggaaatgtggggaaaagcaagagagatcagattgttactgtgtctgtgtagaaagaagtagacataggagactccattttgttatgtactaagaaaaattcttctgccttgagattctgtgaccttacctccaatcccgtgctctctgaaacatgtgctgtgtcaactcagagttgaatggattaagggcggtgcaagatgtgctttgttaaacagatgcttgaaggcagcatgctccttaagagtcatcaccactccctaatctcaagtacccaagcacacaaaaactgcggaaggccgcagggacctctgcctaggaaagccaggtattgtccaaggtttctccccatgtgatagtctgaaatatggcctcgtaggaaaggaaagacctgactgtcccccagcccgacacccgtaaagggtctgtgctgaggaggattagtaaaagaggaaagaatgcctcttgcagttgagacaagaggaaggcatctgtctcctgcctgtccctaggcaatggaatgtctcagtataaaacccgattgtatgctccatctactgagataaggaaaaaccgccttaaggctggaagtaggacctgcaggcagcaatactgctttgtaaagcattaagatgtttatgtgtatgcatatctaaaagcacagcacttaaccctttacattgtctatgatgcaaagacctttgttcacgtgtttgtctgctgaccctctccccacaattgtcttgtgaccctgacacatccccctcttcgaggaacacccacaggtgtggaaaggcaacccacccctaca

SEQ ID NO: 148 - DNA, 5749 bp, Homo sapiens
gtcaggcctctgagcccaagctaagccatcatatcccctgtgacctgcacatacacatccatatggccggttcctgccttaactgatgacattccaccacaaaagaagtgaaaatggcctgttcctgccttaactgatgacattgtcttgtgaaattccttctcctggctcatcctggctcaagagctcccctactgagcaccttgtgacccccactcctgcccgccagagaacaaccccccccctttgactgtaattttcctttacctacccaaatcttataaaatggccccatccctatctccctttgctgactctatttttggactcagcgcacctgcacccaggtgaaataaacagctttattgctaacacaaagcctgtttggtggtctcttcacatggacgtgagtaaaatttggtgccgtgattcagactgggggacctcccttgggagatcaatcccctgtcctcctgctctttgctccatgagaaagatccacctacaacctctggtcctcagaccaaccagcccaaggaacatctcaccaattttaaatccggtaagtggcctctttttactcccttctccaacctctctcactatccctcaacctctttctcctctcaatcttggtgccacacttcagtctctcccttctcttaatttcaattccttttattttctggtagagacaaacgagacacgttttatctgtggacccagaaactccggcgccagtcacggactagggaaggtggccttcccttggtgtttaatcattgcaggaatgcctctctgattattcacacaggttcagaggtgtcagaccatgcagggacacctgccttggtccttcacccgtagcggcaagtactgcttttctggaggaggggcaagaatgcttcaaccccttctccttcacccttagcggcaagtcccacttttctgggagaggggcaggaaccctgacctcttatctctgcaccctgatccgttatttctgtgctccaacctcccttctccatgtctctactctcttttctctgggcttgcctccttcactatgggcaagattctaccttccattcctccttcttctcccttagccggtgttcttaagatcttaaaacctcttcaaatctcacctgacctaaaatctaagcatcttattttcttctgcaacaccgcttgaccccaatacaaactcgacagtagttccaaatagctggaaaatggcactttcaatttttccatcctacaagatctaaataattattgtcataaaataggcaaatggtctgaggagcctgacgtccaggcattcttttacacattgtccctccctagtctctgttaccaatgcaactcgtcccaaatcttcgttctttccctcccacctgtcccctcaatcccaaccccaagcatccctgagtctttctaatctttcttttctacagacccatctgaccgctcccctcctcgccaggctgagctaggtcctaattcttcttcaacctctgctcctccaccctataatccttttatcaccccaccctcctcacaccctgtccggcttacagctttgttccgtgactagccctcccccacatgcccagcaatttactcttaaaaaggtgcctggagctaaaggcatagtcaaggttaatgctcctttttctttatcccaaatcagatagcatttaggctctgtttcatcaaatataaaaatccagcccagttcatggctcgtttgacagcaaccctgagacactttacagccctagaccctaaaaggtcaaaaggtcatcttattctcaatatacattttattacccaatctgctccggacattaaatgaaactccaaaaattaaattctggccctcaaaccccacaacaggacttaattaacctcaccttcaaggtgtacaataataaagtagaggcagccaagtagcaacatatttctgagttgcaattccttgcctccactgtgagacaaaccccagccacatctccagcacacaagaacttccaaacacctgaaccgcagcagccaggcgttcccccagaactgcctcccccaggagcttgctacaagtgccagaaatctggccactagaccaaggaatgcccacagcccaggattcctcctaagctgtgtcccatctgtgcaggaccccactggaaattggtctgttcaactcacctggcagccactcccagagcccctgaaactctggcccaaggctgactgactccttcccagatcttcttggcttagcggctgaagcctgacgctgcccgattgcctcagaagccccgtagaccatctcagacactgagctttaggtaactctcacagtagaaggtaagtccgtccccttcttaatcaatacagaggctacccactccacattaccttcttttcaagggcctgtttcccttgcctccataactgttgtgagtactgaaagccaggcttctaaacctcttaaaactccccaactctggtgtcaacttagacaatactctttttagcagtcctttttaattatccccacctgcccagttcccttattaggctgagacactttaactaaattatctgcttccctgactattcctggactacagctacatctcattgccgcccttcttcccaatccaaagcctcctttgcatcctcctcttgtatgcccccaccttaacccacaagtataagatacctctactccctccttggtgaccgatcatgcaccccttaccatctcattaaaacctaatcacccttacccaacttaatggcaatatcccatcccacagcatgctttgaaaggattaaagcctgttatcactcacctgctacagcatggccttttaaagcctataaactctccttacaattcccccattttatctgtcctaaaaccagacaagccttacaagttagttcaggatctatgcctaatcaaccaaattgttttgcctatccaccccatggtgccaaacccatatactctcctatcctcaatacctccctccacaatccattattctgttctggatctcaaacatgctttctttactattcctttgcaccctccatcccagcctctctttgctttcacctggactgacctgacacccatcaagctcagctaattacctaggctgtactgccgcatagcttcacagacggcccccattatttcagtcaagcccaaattacttcctcatctgttacctatctccgcataattctcataaaaacacacgtgctctccctgctgatcgtgtctggctaatctcccaaaccccaatcccttctacaaaacaacaactccttttcttcctgagcatggttggatacttttgcctttggatacctggttttgccatcctaacaaaaccattatataaactcacaaaaggaaacctagctgaccccatagatcctaaatcctttccccactcctgtttccattccttgaagacagctttagagactgcccccaccttagctctccctgactcatcccaacacttttcattacacacagctgaagtgcagggctgtgcagtcggaattcttacacaaggactgggattgcgtcctgtagcctttttgtccaaacatcttgaccttactgttttaggatggccttcaggtctccgtgcagtggctgctgctgccctaatacttttagaggcccttaaaatcacaaactatgctcaactcactctctacagctctcataatttccaaaatctattttcttcctcacacctgacacatatactttctgctccccggctccttcagctgtactcactctttgttaagtctcccacaattatcattgttcctggcccggacttcaatctggcctcccgcattattcctgataccacacctgacccctatgactgtatctctctgatccacctgacattcaccccatttccccatatttccttctttcctgttcctcaccctgatcacgcttggtttattgatggcagttccaccaggcttaatggccacacaccagcaaaggcaggctatgctatagtacaagccactagcccgcctcttagaacctctcatttcctttccgttgtggaaatctatcctcaaggaaataacttctcagtgttccatctgctattctactacttctcaagggttattgaggccccttcccttccctacacatcaagctcagggatttgcccccacccaggactggcaaattagctttactcaacatgccctgagtcaggaaactaaaatacctcttggtctaggtagacactttcactggataggtagaggcctttcccacagggtctaagaaggccaccatagtcatttcttcccttctgtcagacacaattactcggtttggccttcccacctctatgcagtctgatagtagatcggcctttattagtcaaatcagccaagcagtttttcaggctcttggtattcagtgaaacctttttatcccttacagtcctcagtcttcaggaaaagtagaacggactaatggtcttttaaaaacacacctcaccaagctcagccaccaacttgaaaaggactggacagtacttttaccagtttcccttctcagaattcaggcctgtccttggaattctacaaggtacagcccatttgagctcctgtattgatgctcctatttattaagccccagtctcattccagacaccagaccaacttggactgtgcccaaaaaaacttgtcatccctactatcttctgtctagtcatactcctattcaccgttctcaactactcatacatgccctgctcttgtttacactgccggtttacactgtttatccaagccatcacagctgatatctcctggtgctatccccaaactgccactgttaactcttaaagtaaataaataatctttgctggcaggactatgctgaatctccttaggcactctctaattagatgtcctgggtcctcccaattcttagtcctttaatacctgtatttctccttctcttattccgtttagtttttcattccatacaaaaccatatccaggccatcacaaataattctacatgacaaatgtttctctaaccaccccacaataatcaccccttaccacaaaatcttccttcagcttaatctctccccctctaggttcccacgccgcccctaatcctgcccaaagcagccctgagaaacatcgcccattatctctccataccatcccccaaaattttcgccatcccaacactttaccactattttgttttatttttcttattaatataagaagacaagaatatcaggccactgagcccaagctaagccatcatatcccctgtgacctgcacatacacatccatatggccggttcctgccttaactgatgacattcccccacaaaagaagtgaaaatggcctgttcctgccttaactgatgacattgtcttgtgaaattccttctcctggctcatcctggctcaagagctcccctactgagcaccttgtgacccccactcctgtccgccagagaacaacccccctttgactgtaattttcctttacctacgcaaatcttataaaacggccccacccctatctccctttgctgactctctttttggactcagcgcacctgcacccaggtggaataaacagctttattgctcacacaaaacttgtttggtggtctcttcacatggacgcgagtgaaa

SEQ ID NO: 149 - DNA, 2741 bp, Homo sapiens
tgggtcaggtgcaaagtaagcccaccccactgggacctatgttaaaaaaattttttttcaagagagaatttaaaggagattacggtgttagtatgacaccaggaaaacttagaactttgtgtgaaatagactggctagcattagaggtaggttggccaccagaaggaagcctggacaggtcccttgtttcaaaggtatggcacaaggtaacctgtaagccaaagcacccagaccggtttctgtacatagacagttacagctggttttagaccccctttcccccaccacagtagttaagagaacagcagcataagcggctggcagagccaaggaacgaccagaaaagagaaaaagaggccatctgtaccaattctaagagtttagactaaacaagttcttattaatagcaaaggataattgaaatctcaaacttacaaggttttcaacaaaagtgaagtttgctaaaagttaacagtgtaacatgtattttggtaacttctaatcttgtggccttagacagtctagtccaaagacataaagaaagttcgcttttttaaaaaggaaagaaaaggggggaggcagaatttatattaaaaaaaagttatatggtaaattcttgtcctgaaataaattaactggttgtttaaagaaaaaaaagtttgttaatcagtcaaaaaattgagacatgttaaaaaattgtctgggaaagtcgtgagaaaaaaattataaaaaaaaatttttatgcaaaaaatattgtataatttaaaagtaatgaggcctcctgagtactatttaaaaaaaaaaaaccagttcatgtgcaagatgtataagaaaagtaaaatatacctttggtaaaaaaaaaaattataaaggggcataaacgtggatttttacctacattaaaaggttaaaaaaattattgttttaaaagtttaagcaagctttaaaacgttaattataaaaaaaattctgtgtgtaaacatattagctaaggttaaaaaggtatcatccagtttttctgtgaactggacattaaagtaaaaatgcaagaggtttttcttaaagcatcaacctgctctttaacaaaaattataaaaggttaaaaagagtctataaaatcttaccttatggtcaaacataaaaaattggataaatatgtctacaaggttttattaaaattaagtttaacattaataacacactaatataaaggtaaaatttagcttatctggtataaaagtcatacaggaagcattagtaaatataaaatagtgtttagctttcttttgtctaaaaactaataaaaattggtgctaaaggaagcattcattttactagaggatcataaaagttaaagacttaaaacaaactttggcaattaagacagcataccaagatgcaaatgcctggttgaaatggatcaaatattccatctgcaggttaaacaaaagcaattagcatgcttgtgcacatggcaggccagaggccctgattgtcccccttccactaaggtggtcctccagtcggccaggcatgggctgcatggtagctcttttccaggattctatagcctggagtaataagtcatgccaagctctctctgctatatcccaaagtccctgcaggtcagcccccgagggccatccagcttccatctcccaacactaagttcactacgtgtctctcatggcagggaggagacttagcattccttggagacctgaagggatgcagtgagcttaagaattttcaagagcttatcaatcagtcagcccttgttcatcccaaagcggatgtgtggtggtattgtggtagacctttattggggactctgccgagtaactagagtggcacttgtgctttagtccatttggctatccctttcaccctgacatttcatcaacaagaggaaaaaataataataagaagaagacatcataaagcgagaaaagctccttataggtctttcaactctcacatctatttagatgcaattgaagccccgcaaggagtcccagatcaatttaaagcttgaaatcaaatagttacaggatttaagtcaatattttggtagatgacagtcaataaaaatgtagattagataaactacatctattacaaccaacagcaacgagcttttcatgagttaaaaagaaaaactcatgtcggccccagccctgaggctacctgacctgacaaaactctttacgctctatgtgtcagaaacaaaaaaaatggcagttagagttttaacccagactgtagggccctggccaaggccagtggcctatctctcaaaacaactagatggggtttccaaaggctggcccccatgtccaagggccctggtagcaacggccctgtcacaagaagcagataagctaactcttacacaaaacctaaacataaactccccccatgctgtggtgattttaataaataccaaaggacaccatgctagatgaatgctagactaactagatgccaaagctagctctgtgaaaatccccacataaccattgacgtttgcacaccctaaaccctgccaccttcctcctggtatcagagagcccagttaaccatatctggactcagtttattctagtaggcccaaccaccgagaccacccttaaacatcagtaggctgggagctgtacatggatgggagcagcttcgccaacccctgcaaagtgactctgaagaagacgacaagccctgctccagtcacacctggaagctga

SEQ ID NO: 150 - DNA, 67 bp, Homo sapiens
atatggacagcccaccccaagggaagaatcagaggagaagggacacaagaccccagaaacacacaaa

SEQ ID NO: 151 - DNA, 968 bp, Homo sapiens
gggggaaagaaagagagatcagactgttactgtgtctatgtagaaaaaggaagacataagaaactccattttgacctgtactaagaaaaattattctgccttgagatgctgttaatctgtaaccctagccccaaccctgtgctcacagaaatgtgctgtattgactcaaggtttaatggagttagggctgtgcaggatgtgcctttgtaaacatgtgtttgcaggcagtatgcttggtaaaagtcatcgccattctccagtctcgggtacccagggacacaatgcactgcggaaggccgcagggacctctgcctgagaaagcctgggtattgtccaaggtctcccccaactgagacagcctgagatgtggcctcatgggaaaggaaagatcttactgttcccccagcctgacacctgtaaagggtctgtgctgaggaggattagtgaaagaggaaggcctctttgcagttgagataagggaaggcacctgtctcctgctcatccctgggcaacagaatgtctcagtgtaaaacccaattgtatattccatctactgagataggagaaaaccgccttagggctggaggtgagacatgctggaggcaatactgctctttaatgcattgagatgtttatgtatctgcacatcaaaagcacagcacttttttctttaccttgtttatgatgcagagacatttgttcacaggttttcctgctgaccctcttgcctctattaccctgttgtcctgccacatccccctctccgagatggtagagataatgatcaataaataccgagggaactcagagaccagtgccatcagggttcctccgtatactgagccccggtcccctgggcccacttttctttctctatactttgtctctgtctcttatttcttttctcagcctctcatcccacctgatgagaaatgcccacaggtgtggaggggcaggccaccccttca

SEQ ID NO: 152 - DNA, 990 bp, Homo sapiens
aagaacacgtgagaaagtgtggggaaaagaaagagaaatcagattgttactgtgtctatgtagaaaaggaaacataagaaactccattttgatctgtattaagaaaaattgtttctgctttgagatgctgttaacttgtaactttatccccaaccctgtgctcacagaaacatgtgctgtattggatcaaagtttaatggatttaggactgtgcaggatgtgccttgttaatatgtttgcaggcagtatgcttggtaaaagtcatcgccattctccattctctgttaaccaaggacacaatgcactgtggaaagccacagggacctctgcccaagaaagcctgggtattgtccaacgtttcccccaactgagacagcctgagatatggcctcatgggaaaggaaagaccttaccatcccccagcccgacacccataaagggtctgtgctgaggaggaggagtgaaagagggaggcctctttgcagttgagataagaggaaggcttctctgctcatccctgggaatggaatgtctctgtgtaaagccgaccattcccattcattctattctgagataggagaaaaccgccctgtggctggaggcgagatatgctggcagcaatactgctctgttgctctttgctacactgagatacttgggtaaagagaaacataaatctagccttcgtgcacatccgggcacagtatctttccttgaacttactcatgatacagattcctttgctcacatgtttccctgctgaccttctccccacctgttgccctgctacactccccttgctaagatagtaaagatcatgatcaataaatactgagggaactcagaggctggcgccggtgcgggtccttcgtatgctgagcgccagtgccctgggcccactgttctttctctgtactttgtccctgtgtctatttcttttctcagtctctcatcccacctgacgagaaatacccacaggtgtgaaggggc

SEQ ID NO: 153 - DNA, 765 bp, Homo sapiens
gagagacaggactagctggatttcctaggccgactaagaatccctaagcctagctgggaaggtgaccacttccacctttaaacatggggcttgcaacttagctcacacctgaccaatcagatagtaaggggagctcactaaaatgctaattaggcaaaaacaggaggtaaagaaatagccaatcatctgttgcctgggagcacagcaggagggacaatgatcaggatataaacccaggtattcgagccagcaatggcaaccccctttgggtcccctccctttgtatgggagctctgttttcactctatttcactctattaaatcttgcaactgcactcttctgtgtttgttatggcttgagctgagctttcgctcacagtccaccactgctgtttgccacagtcacagacccgctgctcacttcaatccctccagatcccgcagggtgtccgctgtgctcctgatccagcgaggcacccattgccactcccgatcgtgctaaaggcttgccatttttcctgcatggctaagggcctgggttcatcctaatcgagctgaacactagtcactgggttctacagttctcttccatgacccacagcttccaatagagctataacactcaccgcatggcccaagattccattccttggaatccgtgaggccaagacccccaggtcagagaacacgaggcttgccaccatcttggaagcggctcaccaccatcttgggagctctgtgagcaaggaaccccagtaacaattt

SEQ ID NO: 154 - DNA, 5751 bp, Homo sapiens
gtcaggcctctgagcccaagctaagccatcatatcccctgtgacctgcacatatacatccagatggcctgaaataactgaagaatcacaaaagaagtgatatttaaatggcctgttcctgccttaactgatgacattccaccacaaaagaagtgaaaatggccggtccttgccttaaatgatgacattaccttgtgaaattccttctcctggctcatcctggctcaaaaagctccccgactgagcaccttgtgacccccactcctgcctgccagagaacaaccccctttgactgtaattttcctttagctacccaaatcttataaaacggccccactccatctctcttcactgactctcttttcagactcagcccacctgcacccaggtgattaaaaagctttattgctcacacaaagtctgtttggtggggtctcttcacacagacacaagtgaaattttggtgccatgactcggatcaggggaccttccttgggagatcaatcccctgtcctcctgctctttgctccatgagaaagatctacctacgacctcgggtcctcagaccgaccagcccaaggaacatcacaccaattttaaatccggtaagtggcttctttttactctcttctccaacctctctcactatccctcaacctctttctcctttcaatcttggcgccacacttcaatctctcccttctcttaatttcagttcctttcctttcctcgtagagacaggagacacgttttatccgtggacccaaaactctggcgccggtcacggactcgggaagacagtcttcccttggtgtttaatcatgcggggatgcctgcctgattattcacccacatttcagaggtgtctgaccacatggggacgcctgccttggtccttcacccttaacggcaagtactgcttttctggggggcaagaacctcccaaccccttcttcacccttagcggcaagtaccgcttttctagggggcaagaaccccccaccccttctctccatgtctctactctctcttttctctgggcttgcctccttcactatgggcagccttcacccctccattcctccttctcccttagcctgtgttctcaagaacctcttcaactcacacctgacctaaacctaaacgccttattttcttctacaataccgtttggccccaatacaaactcgacagtggttccaaatagccagaaaacggcacttttgatttttccatcctacaagatctagataattcttatcataaaatgggcaaacggtccgagatgcctgacgtccaggcattcttttacacattgttccctccctagtctgttaccaatgtgacttatcccagatcctccttctttccttcccacctgtcccctcagtcccaaccccaagcattgctgagtctttctaatcttccttttctacagacccatctgacctctctgctcctcaccaggccgagccaggtcccaattcttcctcagcttctgctcccccaccctataatccttttatcacctccactccttccacccagtccagcttacagtttcgttctgtgactagccttcccccaccagcccagcaatttcctcttaaaaaggtggctggagctaaaggcatagtcaaggttaatgctcctttttctttatctgacatctcccaaaatcagttagtgtttaggctctttttcatcaaatatgaaaaacccagcccagttcatggctcatttggcagcaaccctgagacgctttaaagccctagaccctgaaaggtcagaaggccgtcttattctcaatatgcattttattttattacccaatctgttcctgacatgaaataaagctccaaaaattaaattctggccctcaaaccccacaacaggacttaattaacctcacctttaaggtgtacaataatagagtagaggcagccaagtagcaatgtatttctgagttgcaattccttgcctccactgtgagacaagccccagccacatcaccagcatacaagaactccaaacgcctgaaccacagctgccaggggttcctctagaatctcctcccccaggagcttgctacaagtgccagaaatctggccactggaccaaggaatgcccacagcccaggattcctcctaagccatgtctcatctgtgcgggaccccactgaaaatcagactgttcaacttacctggcagccactcccagagcccctggaactctgacccaaggctctctgactgactccttcccagatcctctcggcttagcagctgaagactgacactgcccgattgcctcagaagcctacaggaccatcacagatgctctagataactctcacagtggagggtaagtccatccccttcttaatcaatacagaggctactcactccacattaccttattttcaagggcctgtttcccttgcctccataactgtcgtgggtattgacagccaggcttctaaatctcttaaaactccccaactctggtgccaatttagacaatactcttttaagcactcctttttagttatccccacctgcccagttcccttatcaggccaagacactttaactaaattatctgcttccctgactattcctgggctacagccacacctcattgccaccttttctcccagttcaaagcctccttcacatcctccccttgtatctccccaccttaacccacaagtataagatacctctactctctccttggtgaccgatcatgtacccctaccatctcattacaacctaatcacccttaccctgctcaacgccaatatcccatcccacagcacgctttaaaaggattaaagcctgttatcacttgcctgttacagcatggccttttaaagcctataaactctccttacagttcccccattttacctgtccaaaaacctgacaagccttacaggttagttcaggatctgcaccttatcaaccaaattgttttgcctatccaccccatggtgccaaacccgtatactctcctatcctcaatacctccctccacaacccattattctgttctggatctcaaacatgttttctctactattcctttgcacccttcgtcccagcctctctttgctttcacttggactgaccctgacacccatcaggctcagcaaattacctgggctgtactgccgcaaggcttcacggacagcctccattacttcagtcaagcccaaatttcttcctcatctgttacctatctcggcataattatcataaaaacacacgtgctttccccaccgattgtgtccaactgatctctcaaaccccacaccttctacaaaacaacaactcctttccttcctaggcatggttggatactttcgactttggatacctggttttgccataacaaaaccattatataaactcataaaaggaaacctagctgaccccgtagatcctaaatcctttccccactcctctttccattccttgaagagagctttagagactgcccccaccctagctttccctgactcatcccaacccttttcattacccacagccaaagtgcagggttgtgcagtcggaattcttacacaagaaccgggactacgccctgtaacctttttatccaaacaacttgaccttactgttttgcctagccctcaagtctgtgtgcagtggccaccactgccctaatacttttagaggcccttaaaattacaaactatgctcaactcactctctacagttctcataacttccaaactctattttcttcctcacacctgacacatatactttctgctccccggctccttcagctgtactcactctttgttgagtctcccacaattaccattgttcctggcctggacttcaatccggcctcccacattattcctgataccacacctgagccccatgactatatctctctgatccacctgacattcaccccatttccccatacttccttctttcctgttcctcacccagatcacacttggtttattgatggcagttccaccaggcctaatcgcaacacaccagcaaaggcaggccatgctatagttcaagccactagcctgcctcttagaacctctgatttcctttccatcgtggaaatctattctcaaagaaataacttctcagtcttccatctgctattctactactcctcagagattattcaggccccctcccttccctacacatgaagctcagggatttgcccctgcccaggaccggcaaattagctttactcaacatgccctgagtcaggaaactaaaatacctcttggtcttggtagacactttcactggataggtagaggcctttcccacaggatctgagaaatgacccaccacggtcatttctttccttctgtcagacagaattcctcggtttggccttcccacctctatacagtcctgtaagggaccggcctttattagtcaaatcacccaagcagtttctcaggctcttagtattcagtgaactaatggtcttttaaaaccacaccttaccaagctcagccaccaacttaaaaaggactggacaatacttttaccacttgcccttctcagaattcgggcctgtccttggaatgctacaaggtacagcccatttgagctcctgtatagacgctcctttttattaggccccagtctcattccagacactagaccaacttggactgcaccccccaccaaaaaaaaaaaaaaacttgtcgtccctactatcttctgtctagtcatactcctattcaccattctcaactactcataaatgccctgctcttatttacactgccgatttacactgtttctccaagccaccacagctgatgtctcctggtgctatccccaaaccgccactcttaactccctcttaaagtaaataaatcatctttgccggcagggctatgctgaacttccttaggcactctctagttagatgtcctaggtcctcccaattcttactcctttaatacctgtttttctccttgtcttattccattattttttcaattcccacaaaattgtatccaggccatcaccaataattctataagacaaatgtttcttctaacaaccccacaatatccccccttaccacaaaatcttccttcagcttaatctctcccactctaggttcccacgccacccctaatcctgctcgaagcatccctgagaaacatcgcccattatctctccataccacccccaaaaattttcgccaccccaacacttcaacactattatgttttatttttcttactaatataagaagacaggaatgtcaggcctctgagcccaagctaagccatcatatcccctgtgacctgcacgtatacacctagatggcctgaagtaactgaagaatcacaaaagaagtgatatttaaatggcctgttcctgccttaactgatgacattccaccacaaaagaagtgaaaatggccggtccttgccttaactgatgacattaccttgtgaaattccttctcctggctcatcctggctcaaaaatctcccccactgagcaccctgtgacccccccactcctgcccgccagagaacaactgcctttgactgtaattttcctttacctacccaaatcttataaaatgaccccacccctatctctcttcactgactctcttttcagactcagcccacctgcacccaggtgattaaaaagctttattgctcacacaaagcctgtttggtggtctcttcacacggatgcgagtgaaa

SEQ ID NO: 155 - DNA, 5703 bp, Homo sapiens
gtcagccctctgagcccaagctaagccatatcccctgtgacctgcatgtacacatccagatgggcagttcctgccttaactgctgacattctaccacaaaagaagtgaaaatggcctgttcctgccttaactgatgacactgtcttgtgaaattccttctcctggctcatcctggctcaaaagctcccccactgagtaccttgtgacccccactctgcccgccagagaacaaccccccctttgactataattttcctttacctacccaaatcttataaaatggccccacccctgtctcccttcactgactcttttcggactcagcccacctgcacccaggtgaaataaacagctttactgctcacacaaagcctgtttggtggtctcttcacacagacgtgcatgaaatttggtgccatgactcggatcgggggacctcccttgggagatcaatcccctgtcctcctgctctttgctccatgagaaagatccacctatgacctcaggtcctcagaccaaccagcccaagaaacatctcatcaatttcaaatctggtaagcggcctctttttactctcttctccaacctctctcactgtccctcaaccactttctcctttccactcttcaatctctcccttcttttaatttcaattcctttcattttctggtagagacaaaggagacacgttttatccgtggacccaaaaccccagcgccggtcacggactagggaaggcagccttcccttggtgtttaatcattgcagggacactgctctgattattcacccaggtttcagaggtgtcagaccacgcagggatgcctgccttggtccttcacccttagcggcaagtcctgcttttctggggtaggggcaagtaccccaaccccttctctccatgtctgtaccccttctctgcctttctgggggacaagaaacccccaaccccttctccttcacttttagtggcaagtcccacttttctagaggaggggcaagtaccccaacctcgtatctctgtgccccaatcccttatttccatgccccaacctcttacatctttgtaccccaatcccttatttctgtgcactgacctcttatctctgtgccccaatcccttatttccatgccctgaccttgtatctctgtgccccaacccctttcccactttactggagggtaagaacccccaaaccccttccctccatgtctctctcttttctctgggcttgcctccttcactatgggcaaacttccaccctccattcctccttcttctcccttagcttgtgttcttaagaacttaaaacctcttcaactctcacctgacctaaaatctaagcatcttattttcttctgcaatgccgcttgaccccaatacaaacttgacagtagttccaaatagccagaaaatggcactttcaatttttccatcctacaagatctaaataattcttgtcataaaatgggcaaatgatctgaggtgcctgatgtccaggtgttcttttacacatcagtccctctctagtctctgttcccaatgcaattcctaccaaatcctccttctttccctcccacctgtccccttagtcccaaccccaagcgtcgctgagtctttccagtcttccttttctacagacccatctgatctttcccctcctcctcaggctgcttgtcaccaggccaagctaagtcccaattcttcctcagcccctgttcctccaccctataatccttttatcacctcccctcctcacaccccgtccggcttacagtttcgttccttgactagccctcacctgcccagcaatttactcttaaaaaggtggctgaagctaaaggcatagtcaaggttaatgctcctttttctttatcagacctctcccaaatcagtgagcgtttaggctctttcatcaaatatgaaaaacccagcccagttcatgactcatttggcagcaaccctgagatactttacagccctagaccctgaaatgtcaaaaggccatcttattctcaaaatacattttattacccaatctgctcccgacattaaataaaactccaaaaattaaattccagccctcaaaccccacaacaggatttaattaacctcgccttcaaggtgtacaataatagaaaagagttgcaattccttgcctccactgtgagacaaaccccagccacacctccagcacacaagaacttccaaacgcctgaaccgcagtggccaggcgttcctccagaacctcctcccccaggagcttgctacaagtgccagaaatctggccaccagggcaaggaatgcctgcagcccaggattcctcctaagctgtgtcccatctgtgccggaccccactggaaatcagactgttcaactcacctggcagccactcccagagctcctggaactctggcccaaggctctctgactgcttcccagatcttcttggcttagcagctgaagactgacactgcccgatcgcctcggaagccccctagaccatcacggacgctgagcttcaggtaactctcacagtggagggtaagtctgtccccttcttaatcaataccaaggctactcactccacattaccttattttcaagggcctgtttcctttgcctccataactgttgtgggtattgacagacaggcttctaaacttcttaaaactccccaactctggtgccaatttagacaatactcttttaagcactccttttagttatccccacctgcccagttcccttattaggccgagacacttcaactaaattatctgcttccctgactattcctggattacagctacatctcattgctgcccttcttcccaatccaaagcctcctttgcatcctcctcttgtattcccccaccttaacccacaagtataagatacgtctactccctccttggcgaccgatcatgcaccccttaccatctcattaaaacctaatcacccttactctgctcaatgccaatatcccatcccacagcatgctttgaaaggattaaagcctgttatcacttgcctgctacagcatggccttttaaagcctgtaaactctccttacaattcccccattttacctgtccaaaaaccagacaagtcttacagattagttcaggatctgagccttatcaaccaaattgttttgcctatccatcctgtggtgcccaacccgtacactcttttgtcctcaataccttcctccacaactcactattccgtgcttgatcttaaagatgcttttttcactattcccctgcacccctcataccagcctctctttgctttcacttggactgaccctgacacccattaggctcagcaagtcacccgggctgtactgccgcaaggcttcacagacagcccccattacttcagtcaagcccaaatttcatcctcatctgttacctatctcggcataattctcataaaaacacacgtgctttccctgctgatcatgtccgattaatctcccaaacctcaatcccttacaaaacaacaactcctttccttcctaggcatggttagtgcggtcagaattcttacacaagagccaggaccgcaccctgtagcctttctgtccaaacaacttgaccttactgttttagcctagccctcatgtctgcgtgcagctgccactgccgccctaatacttttagaggtcctcaaaatcacaaacgatgctcaacttactctctacatttctcataacttccaaaatctattttcttcctcatacctgatgcatatactttctgctccctggctccttcagctgtactcactctttgttaagtcccacaattaccattgttcctggcccagactccaatccggcctcccacattattcctgataccacacctgacccccatgactgtatctctctgatccacctgacattcaccccatttccccatatttccttctttcctgttcctcaccctgatcacgcttgatttattgatggcagttccaccaggtctaatcgccacacaccagcaaaggcaggctatgctatggtacaagtcactagcccgcctcttagaacctctcattttctttccatcgtggaaatgtatcctcaaggaaataacttctcagtgttccatctgctattctactactcctcagggattattcaagccccctcccttccctacacatcaagctcgaggttttgcccccacccaggactggcaaattagctttactcaacatgccctgagtcaaataactaaaatacctcttagtctaggtagacactttcactggataggtagaggcctttcctacagggtctgagaaggccactgcagtcatttcttcccttctgtcagacatgattcctcagtttagccttctcacctctatacagtctgataacagaccagcctttattagtcaaatcagccaagcagtttttcaggctcttagtattcagtgaaacttttatatcccttacggtcctccgtcttcaggaaaagtagaatggactaaaggtcttttaaaaacacacctcaccaagctcagccaccaacttaaaaaggactggacaatacttttaccactttcccttctcagaagtcagacctgtcctcagaatgctacaaagtacagcccatttgagctcctgtatagacgatcctttttattaggccccagtctcattccagacaccagaccaacttagactgtgccccagaaaaacttgtcatccctactatcttctctctagtcatactcctattcaccgttctcaactactcatacatgccctgctcttgtttacactgccggtttacactgtttctccaagccatcacagctgatatcacctggtgctatcctcaaactaccactcttaactattgaagtaaataaataatctttgctggcaggactatgctgaatctcctcaggcactctctaatcagatgtcccgagtcgtcccaatatttagaccttttatacctgtttttctccttattccatttagttttcaattcatacaaaactgtatccaggccatcaccaataattctaaatgacaaatgtttcttctaacaaccccacaatatcacctcttaccacaaaatcttccttcagcttaatctctcccattctaagttcccacgccgcccctaatcccgctcgaagcagccctgagaaacatcacccattatctctccataccatcccccaaaattttcgccacctcaacactttaccactatttcattttatttttcttattaatataagaagacaggaatgtcaggcctctgagcccaagctaagccatcatatcccctgtgacctgcaggtacacatccagatggccggttcctgccttaactgctgacattccaccacaaaagaagtgaaaatggcctgttcctgccttaactgatgacagattgtcttgtgaaattccttctcctggctcatcctggctcaaaagctcccccactgagtaccttgtgacccccactctgcccaccagagaacaatcccctttcgactgtaattttcctttacctactgaaatcctataaaatagccccacccctatctcccttcgctgactctcttttcgggctcagcccgcctgcacccaggtgaaataaacagctttattgctcacacaaagcctgtttggtggtctcttcacaccgacgcgcatgaaa

SEQ ID NO: 156 - DNA, 7049 bp, Homo sapiens
cccctttgggtcccctccctttgtacaggagctctgttttcactctattaaatcatgcaactgcacacacttgtggtccgtgtttgttacggctcgagctgagcttttgctcactgtccatcactgctgtttgccactgtcccagacccaccgttgacttccacccctccagatccagcaggatgtcctctgtgctcctgatccagtgaggcacccattgctgctcctgatcgggctaaaggcttgccattgttcctgcacaactaagtgcctgggttcttcctaatcgagctgaacagtagtcgctgggttccacagttctcttccgtgacccatggcttctaatagagctataacactcaccacatggcccaagattccattccttggaatccctgaggccaagaaccccaggtcagagaacaagaggcctgccgccatattggaagtggccctgccgccatcttgggaactctaggcacaaggaccccctggtaacattttggtgaccacgaagggacctccaaagcagtgaataatattgaaccactttggcttgctattctgtcctatccttccttagaattggaggaaaataccaggcacctgtcagctggttaaaaataattagcatggccgccagacttaagactcaggtgtgaggttgtctgggaaagagctttctaacaaacccaaaccttctggattgggagcgttggtctgcctggaaccagcttccgctttcaattttcctgggatagctgagggccgactagaagcagaaagctgtcatcccgaactcctggtgttagccggttgagatcatggcgcagacagaagtctctactcaacagatgcccatgcgtacacccctacttttccttctgacccatagcttctgggtcccgaccacgactttcttgaaagtgtagcccaaaattctccttacctctgaatctacttcctctgatccctgcctcctaggtactaatgattcagactttcatttcctctagcaagctgtatttccaaagggatctaaggaagctctacactgcgtccttaggcccctaggctacgaagccagagagtcttgtccctggtgtctctcccaatttaggcatacagctctcgacatgggcagttatgtgggacctgttccccaccacccttgccagggccccaagtttgtaaagggctaggagaaaagagaaagagagacaaagggggccaaagagagaaagagaaagatagaagtagtaaaggaaaaacagtgtgccctattcctttaaaagccagggtaaatttaaaacctataattgataatggaaggtcttctccgtgaccctgtaacactccaatactaccttgttgtcagggtaaacaagggcgtagcccgaaaacactgagaccactgacaactccgtagccttcctatcaaaaatctttcacccagtgacccatggatgggccaaatgcattcagtcggtagcggcaactgcattgctaaaagtagaaaaataatctttagaggaaacctcattgtgagcacctcaccagttcagaattatcctaagtcaaaaaagcaaaaagttagcttactaactcaaatcttaaagtatggggctattctgttagaaaaaggtgatttaacattaaccactgaaaattcccttaacctagcagatttcctaacaggggatttaaatcttaattaccatacaaaggtctgaccagacctaggaggaactcccttcaggacaggagatagagggttcctcccggtgactgaggaaaaaaacacagtgggtattcagcaattgatagggagaatcttgtggaagcagagttaggaaaattgcctaataattggtctgctcaaacctgcgagctgtttgcactcagccaaaccttaaagtacttacagaatcaaaaagactctatctcaatcccgactcaaaaggttacctacaccctctctgaaacaaatttgcctaagaactgttgtttatgggaatgcatgttgatggggcagctggggtgttatgaaatgctcaggaacccagcccagctctagaattcacctctgagtgcaaaggcaacgttgggcacgctggtaaaggaccactagaatccagcagccggacccctttctttgtggtcaagaaaggcgggaaaacaggtgcaggactgctacatcagtgagcgtaactaatccgataagcagaagtccatgggtggttacacaccctggaaaggaataagcattaagaccatagaggacgctctaggactaatgctcatcagaaaatgatttggggtgctggcatccctatgttctttttttcagatgggaaacattccccccaaggcaaagtacatctcctaagatgtactttggagaattgggaccaatttgaccctcaaacgctaagaaagaaatgacttatattcttctgcagtactgcctggccacgatatcctcatcaagggggagaaacctggcctcccgacggaagtataaattataacatcttacagctagacctcttttgtataaaaaaagaggcaaatggagtgaagtgccatatgtacaaactttcttttcattaagaaacaagtcacaattatgtaaaaagtgtgatttatgccctacaggaagccctcagagtctacctccctatcccggtgtccccccagcttcttccccaactaataaggacccaaaaggagatagacaaaggggtaaacaatgaaccaaagagtgccaatatttcccgattatgccccctccaagcagtgcgaggaggagaattcggcccagtcagagtgcatgtacctttttctctctcagacttgaagcaaattaaaatagaccggggcaaattatcagataaccctgatggctatattggtggtttacaagggttaggacaatcctttgatctgacatggagagatataatgttactgctaaatcagacactaacaccaaatgagagaagggccgccataactgcagcccgagagtttggtgatctctggtatctcagtcaggtcaatgataggatgacaacagaggaaagaacaattccccaaggccagcaggcagttcccagtgtagaccctcactgggacacagaatcagaacatggagattggtgccacagacatttgctaacttgcgtgctagaaggactaaggaaaactaggaaaaagcctacaaattattcaatgatgtccactataacacagggaaaggaagaaaatcctactgcccttctggagagactaagggaagcactgaggaagcattcctccctgtcacctggctattaaaggccaactaatcttaaatgataagtttatcactcagtcagctgcagacattagaaaaaaacttcagaagtgtgccttaggccctgagcaaaacttagaaaccctattgaacttggcaatctcggttttttataatagaaatcaggaggagcaggtggaatggggcaaacgagataagaaaaaggccactgctttagtcatggccctcaggcaagcagactttggaggctctggaacagaaaggctgggcaaatccaacgcctaatagggcttgcttccagtgtggtctacaaggacactttaaaaaagattgtccaaatagaaataagccgccccctcgtccatgccccttatgtaaagggaatcactggaaggcccactgccccaggggacgaaggtcctctgagtcagaagccactaaccagatgatccagcagcaggactgagggtgcctggggcaagtgccagcccatgccatcgacctcacagagccccgggtatgcttgaccattgagggccaggaggttaactgtctcctggacactggcgcagccttctcagtcttactctcctgtcccggacaacggtcctccaaatctgtcactatccgagaggtcctaggacagccagtcactagatacttctcccagccactaagttgtgactggagaactttactcttttcacatgcttttctaattatccctgaaagccccactcccttgttagggagagacattctagcaaaagcaagggtcattatacacctgaatataggacaaggaacacccgtttattgtcccctacttgaggaaggaattaatcctgaagtctggggaacagaaggacaatatggacaagcgaagaattcctgtcccgttcaagttaaaggattccgcctcctttccctgccaaaggaagtacccccttagacccgaggcccaacaaggactccaaaagattgttaaggacctaaagcccaaggcctagtaaaatcatgcagtagcccctacaatactccaattttaggagtacagaaacccaacggacagtggaggttagtgcaagatctcaggattatcaatgaggccgttgtccctctatacccagctatacctaacccttatactctgctttcctaaatgccagaggaagcagagtggtttacagttctggaccttaaggatgcctttttctgcatccctgtacatcctgtcaatttttgtttgcctttgaagatccttcaaacccaacgtctcaactcacctggactgttttacctcaagggttcagggatagcccccatctatttggccaggcattagcccaagacttgagccagttctcatactgaaggacactcttgtccttcggtacgtggataatttacttttagtcgcccattcagaaaccttgtgtcatcaagccacccaagcgcttttaaacttcctcgccacttgtggctacaaggtttccaaaccaaaggctcagctctgctcacagcaggttaaatacttagggctaaaattatccaaaagcaccaaggcgctcagcgaggaacgtatccagcctatattggcttatcctcatcccaaaaccctaaagcaactaagagggttccgtggcataacaggcttctgctgaatatggattcccaggtatggcgaaatagccaggccattatatacactaattaaggaaactcagaaagccaatacccatttagtcagatgtacgcctaaagcaaaagcggctttccaggccctaaagaaggccctaacccaagccccagtgttaagcttgccaacaggccaagacttttctttacatgtaacagaaaaaaaacaggaatagctctaggagtccttacacaggtccgagggaccagcttgcaacctgtggcatacctgagtaaggaaactgatgtagtggcaaagggttagcctcattgtttatgggcagtggcagcagtagcagtcttaggatctgaagcagttaaaataatacagggaagagatcttactgtgtggacatctcataatgtaaacagcatactcactgctaaaagagacttgtggctgtcagacaaccatttgcttaaatatcaggctctattaaagagccagtgctgcaactgtgcacttgtgcaactcttaatccagccacatttcttccagacaataaaaaaaagaacataactgtcaacaggtgattgctcacacctacgccgcttaaggggaccttctagaggttcccttgactgatcccgacctcaacttgtatactgatggaagttcctttgtagaaaaaggacttcgaaaagcagggtacgcagtgctcagtgataatggaatacttcaaagtaaccccctcactccaggaactagcgctcagctggcagaactaacagacctcattcaggcactagaattagaaggaaaaagggtaaatatatatacagacactaatatgcttacctagtcctccatgaccacgcagcaatatggagagaaagggaattcctaacttccaaggaacacctatcaaacatcaggaagccattaggagattattcttggctgtacagaaacctaaagaggtggcagtcttaaactgccggggtcatcagaaagaaaaggaaagggaagtagaagggaaccaccaagacgacactgaagccaaaagagccgcaaggcaggaccctccattagaaatgcttatagaaggaccctagcatggggtaatcccctccgggaaaccaagccccagtactcagaagaagaaatagaatggggaacctcacgaggatgtagtttcctcccctcaggatggctagccaccaaagaaggaaaaatacttttgcctgcagccaaccaatggtagttacttaaaacccttcaccaaacctttcactctcgctgcacctcctccttgccgctgtactaccagtagctccctttaccaagagcttctatggagaatgcagcttcccagaaatattgacgccccattgtagtttttctaaaggaaaccccactttcaccacccacacccatatgcccctgcacttcaggtcatacatttcaattcctgtatctttaacctccttgttaagtttgtctcttccagaatcaaagctataaaactacaaatggttcttcaaatggggccccagatgcagtccatgactaagatctaccgcagacccctggaccggcctgctagcccatgctccgatgttaatgacatcgaaggcacccctcccgaggaaatctcgactgcacgacccctactataccccaattcagcaggaagcagttaaaagcagtcgtcagccaacctccccaacagcacttgggttttcctgttgagaggggggactgacagacaggactagctggatttcctaggccaactaagaattcctaagcctagctgggagaggtgactgcactcacctttaaacacagggcttgtaactcagctcacacccgaccaatcaggtagtaaacagggctcactaaaagacaaattaggctaaagcaggcggtaaagaaatagtcaaatcatattatcgcctgaagagcacagggggaggggcaatgatcggtatataaaccccaggcatttgagcagggagcgacaatcccctttgggtcccctcccattttatgggagctctgttttcgctctattaaatcttgcaactg

SEQ ID NO: 157 - DNA, 670 bp, Homo sapiens
gtaagtagctaatcagtcataagcaagtcaggggaggactccccaccaccaccaggaatgtcaagtgaccatcaggtgatggtcaggtggttgttacattgtatttctaaaataataattggttgcagccagtggcagggaaaggcagtcttccaatagatagaataaacctgaaactggtgatcagcagctttccaataggatcccaggagttggggagtgggctcaagcatgcaaaatgacagagtttaactggcatatgaccttctaggaacattcagctggtaaaggaagaatgccttaagtgagcatgcatacaaatacagtaaacgcattgcgcatgttcccctccgaagcactggcaggacactgtgcatgtggatagctcaccccaaggcaagaataggagagaaggtacacaagacgctggaagcatggcaaggtataaaaccccaagtcaaaggtcaaaccgtgccctgatctctcaaattgcctgcttggccctcttccaagtatactttacgtcctctcattactgctctaaagctttttaataaactttcactcctgctctaaaacttgccttggtctctcactctgcctagtgcccctcagtctaattctttcttctgacaaggcaagaattgaggttgctgcagacccatacaaa

SEQ ID NO: 158 - DNA, 5854 bp, Homo sapiens
atcaggcctctgagcccaagctaagccatcatatcccctgtgacctgcacatacacatccagatggccggttcctgccttaactgatgacattccaccgcaaaagaaatgaaaatggcctgttcctgccttaactgatgacattatcttgcgaaattccttctcctgcctcaccctggctcaaaagctcccctactgagcaccttgtgacccccactcctgcccaccaaagaaaaatccccctttgactgtaattttcctttacctacccaaatcttataaaacggccccacccctatctccctttgctgactcttttcagactcagcccccctgcacccaggtgaaataaacagctttattgctcacacaaatcctgtttggtggtctcttcacacagacgcgcataaaatttggtgccgtgactcagatcgggggacctcccttgggagatcaatcccctgtcctcctgctctttgctccatgaaaaagatccacctacgacctcaggtcctcagacccaccagcccaaggaacatctcaccaattttaaatcaggtaagtggcctcctcttactctcttctccaacctctctcactatccctcaaccactttctccttcaatcttggcgtcacccttcaatctctcccttctcttaatttcaattcctttcattttctggtagagacaaaggagacacgttttatctgtggattatccatggacccaaaactccggtgtccatcaaggacttgggaaggcagacttcccttggtgtttaatcattgcagggatgcttttctgattattcacccacgtttcagaggtgtctgaccacgcagggatgtctgccttggtccttcacccttagcgccaagtcccgcttttctggcagagggccaagaactccaaccccttcactccgtgtctctaccccttctctgcttttctgggtggcaagaacccctgatcccttatttccatgccccaacccctgatctctgcaccctgatcccttattttcatgccctgacctcttatttctgcaccccaaccccttatttccataccccgacccctttcccacttttctggagggtaagaacccctgaacccttcccttcatgtctctactctcccttttctttaaacttgcctccttcattatgggcaaccttccaccctccattcctccttcttctcccttagcctgtgttcataagaacttaaaacctcttcaactctcgcctgacctaaaatctaagcatcttattttcttctgcaacaccgcttagccccaatacaaatttgacaatggctctaaatagccagaaaatggcactttcatgttttccatcctacaagatctaaataattcttgttgtaaaatgggcaaatggtctgaggagcctgacatccaggcattcttttacatatcagtccctccctagtctctgttcccaatgcaactcatcccaaatcttccttctttccttcctgcctgtcccctcagtcccaaccccaagcatcgctgagtctttctaatcttccttttctacagacccatctgacctctctcctcctagccaggccaggctaggtcccaattcttcctcagcctccactcctccaccctataatccttttatcacctcccctcctcacacctggtctggcttacagtttctttccccgactagccctcccccacctgcccagcaatttcctcttaaaaaggtggctggagctaaaggcatagtcaaggttaatgctcctttttctttatctgacctctcccaaatcagttagtgtttaggctctttttcatcaaatataaaaaacccagcccatttcatggccccttagcagcaaccctgagatgctttacagccctagaccctgaaaggtcaaaaggccgtcttactctcaatatacattttattttattacccaatctgctcccgacattaaataaagctccaaacattaaattccggccctcaaaccccaaaacaggacttaattaaccttgccttcaaggtgtacaataatagagtagaggaagccaagtagcaacatatttctgagttgcaattctttgcctccactgtgagacaaaccccagccagccacatctccagcacacaagaactcccaaatgcctaaactgcagtggccaggcgttcctccaggcccgcctcccccaggagcttgctacaagtgccagaaatctggccaccagaccaaggaatgcccgcagcccaggattcctcctaagctgcttcccatctgtgcaggaccccactgaaaatcggactgttcaacttacctggcaaccactcccagagcccctggaactctggcccaaggctctctgactccttcccagatcttctcggcttagcagctgaagactgacactgcccgatagcctcggaagcctacaggaccatcacagatgctctaggtaactctcacagtgcagggtaagtccatccccttcttagtcaacatggaggctacccactccacattaccttcttttcaaaggcctgcttcccttgcctccataactgttgtgggtattgacagccaggcttctaaacctcttaaaactccccaactctggtgccaacttagacaatactcttttaagcactccttttaattatccccacctgcccagttcccttattaggctgagacactttaactaaattatctgcttccctgactattcctggactacagctgcatctcattgctgcccttcttcccaatccaaagcctcctttgcatcctcctcttgtatccccccaccttaacccacaagtataagacacctctactccttccttggcgacaaatcacgcaccccttaccatctcattaaaacctaatcacccttaacccactcaatgccaatatcccaccccacagcatgctttgaaaagattaaagcctgttatcactcgtctgctacagcatggccttttaaagcctataaactctccttacaattcccccattttaactgtctagaaccagacaagccttacaggtttgttcaagatctgcaccttatcaacaaaattgttttgcctatccaccccatgatgccaaacccatatactctcctatcctcaatacctccctccacaacccattattctgttctagatctcaaacatgctttctttactattcctttgcacccttcaccccagcctctcttggctttcacttagactgaccctgacacccatcaggctcagcaaattacctgggctgtactgccgcaaggcttcacagacagcccccattacttcagtcaagcccagatttcttcctcatctgttacctatctcggcataattctcataaaaacacacgtgctctccctgtggatcatgtccagctgatctctcaaacccccaacacctacaaaacaacaactcctttccttcctaggcatggttagatactttcgactttagatacctggttttgccatcctaacaaaaccattatataaactcacaaaaagaaacctagctgaccccatagatcctaaatcttttccccactcctctttccgttccttgaagacagctttagagactgccccgaccctagctctccctgactcatctcaacccttttcattacacacagctgaagtgcagggctgtgcagtcagaattcttacaaaaggaccaggatcgcgtcctgtagcctttttgtccaaacaacttgaccttactgttttaggctggccatcatgtctccatgcagtggctgctgccaccctaattctttagaggcccttaaaatcacaaactatgctcaattcactctctacagttctcataacttccaaaatctattttcttcctcacacctgacacatatactttctgcttcccggctccttcagctgtactcactctttgttaagtctcccacaattaccattgttcctggcccagacttcaatctggcctcccacgttattcctgataccacacctgacccctatgactgtatctctctgatccacctgacattcaccccatttccccatattttcttctttcctgttcctcaccctgatcacacttagtttattgatggcagttccaccaggcctaatcaccacacaccagcaaaggcaggccatgctatagtacaagccactagtccacctcttaaaacctctcatttcctttccatcgtggaaatctatcctcgaggaaataacttctcagtgttccatctgctattctactacttctcagggattattcaggcctcctcccttccctatacatcaagctcaaagacttgcccccacccaggactggcaaattagctttactcaacatgccctgagtcagataactaaaattcctcttagtctaggtagacactttcactggataggtagaggcctttcctacaaggtctgagaatgccaccgcagtcatttcttcccttctgtcagatataattcctcagttgagccttcccacctctatacagtctgataacagatcagcctttattagtcaaatcagccaaacagttttttaggctcttagtattcagtgaaatctttatatcccttacattcctcagtcttcaggaaaagtagaacggactaaagatcttttaaaaacacacctcaccaagttcagctgccaacttaaaaaggactagacaatacttttactgctttcccttctcagaattcaggcctgtccttggaatgctatagggtacagaccatttgagctcctgtatggatgctcctttttattaggccccagtctcattccagacaccagaccaacttggactgtgccccaaaaaacttgtcatccctactatcttctgtctagtcatactcctattcaccgttctcaactactcaaacatgccctgttcttgtttacactgccagtttacactgtttctccaagccatcacagctgatatctcctggtgctgtccccaaactgccactcttaactcttaaagtaaataaataatctttgctggcaggactatgctgaacctccttaggcactccctaattaaatatcctaggtcctcccaattctcagacctttaatacctgtttttctccttctcttattccatttttcaattcatacaaaaccgtatccaggccatcaccaatcattctgaatgacaaatgtttcttctaacagtcccacaatatcaccccttaccacaaaatcttccttcagcttaatctctcccactctaggctcccacgctgcccctaatcctgctcgaaacagccctgagaaatatcgcccattatctctccaaaccatccccccaaatttttgccgtcccaacactttaccactatttcattttatttttcttattaatataagaagacaggaatgtcaggactctgagcccaagctaagccatcatatcccctgtgacctgcacatacacatcctgatggccggttcctgccttaactgatgacattccaccacaaaagtaatgaaaatggcctgttcctgccttaaccgatgacattatcttgtgaaattccttctcctggctcatcctggctcaaaagctcccctactgagcacgttgtgacccccactcctgcccgccaaagaaaaacccccctttgactgtaattttcctttacctacccaaatcttataaaacagccccacccctatctcccttcactgactctctttttggactcagcctgcctgcacccaggtgaaataaacagctttattgctcacacaaatcctgtttggtggtctcttcacacggacgcgcataaaa

SEQ ID NO: 159 - DNA, 380 bp, Homo sapiens
tcaggcctctgagcccaagctaagccatcatatcccctgtgacctccacgtatacatccaggtggcctgaagtaactgaagaatcacaaaagtgaaaatggcctgttcctgccttaactgatgacattaccttgtgaaattccttctcctggctcagaagctcccccactgagcaccttgtgacccccacccctgcccaccagagaacaaccctctgactgtaattttccactacctacccaaatcctataaaacggccccacccctgtcacctttcgctgactctcttttcggactcagcccgcctgcaggtgaaataaacagccttgttgctcacacaaagcctgtttggtggtctcttcacacggacgcaagtgaaa

SEQ ID NO: 160 - DNA, 928 bp, Homo sapiens
gtggggaaaaggaggacagatcagactgttactgtgtctatgtagaaagaaatagacataagagactccattttgttctgtactaagaaaaattcttctgccttgagatgctgttaacctgtaaccctagccccaaccctgtgctcccagaaacatgtgctgtgtcacacgtgggtttagggctatgcaggatgtgctttgttaaacagatgcttgaaggcagcatgcttgttaaaagtcatcaccactctctaatctcaagcacccagggacacaatacactgcggaaggctgcagggacctctgcctagaaaagccaggtattgtccaaagtttctccccatgtgatagcctgagataaggcctcgtgggaagggaaagaccagaccgtaccccagcccgacacccgtaaagggtctgtgctgaagaggattagtataagaggaaggcctttttgcagttaagaggaaggtatctgtctcctgctcgtccctgggcaatggaatgtctcggtgtaaaacccgatggtatgttccatccaccgagataggggaaaaccgccttagggctggaggtgacacatgctggcagcaatactgctctttaatgcaccagatatgtttatgtatgagcacatcaaggcacagcacatttcctaaccttgtttatgacacagacatttgctcacatgttttcctgctgaccctctccccactgttaccctattgtcctgccacatccccgtctccgagatggtagagataatgaccaataaatactgaaggaactcagagacccggccggcgcgggtctcctgagcccacttttctttctgtgtactttgtctctgtgtctctttcttttctcagtctctcgtcccacctgacaagaaacacccacaggtgtggaggggcaggccaccccttca

SEQ ID NO: 161 - DNA, 10042 bp, Homo sapiens
ttggagtaggtagttaggcagacatgaacatcagaagaaaagcccatcccccaccagtaatgtcaggcaaccattaggtgatggtcaggtagttgttaagcagtctttttaaaataataattggttgcagtcagtgccagagaaaggcagtctcccaatatatggaaaacacttgaagccggtggccaacagcttcccaataaggagctgagcaagcagtctcaagcatgcactaagaggcaaaatggcagagtttaactggtgtatgaccagttcctctaggaacacttgactggcaagggaaaaacgcctcaagtgagcatgcacacaacttcagtaaatacactgtgcatgtggccgctcacaagtgctggcaggccactgtgcatgtggatggcccaccccaaggaaaaatcaagagtggagagacacaaaactccagaagcatgccaacatataaaaccccaagtcaaaggtcaaacagggcacttggatttctcaggttgccaacttggccctcttccaagttactttactttctttcattcctgctctaagagtttttaataaactcttacttctgctcaaaaacttgccttggtctctcactctcgcttatgcccctcagacaaattctttcctttgaagaggcaagaaacaagttcttgcagacccatacagattcactgctgctaacatactttgatgccacatggcttggatacgttccccagtggtaagaaatctctatgcctctccttctttggctggagaagaaggagatctgtacacagttttcttctcccctttcactctcctgccttccaaccaattcccagaactattactctcagccacagtggctctgcacccgctggctgatctctcagcttaccctgaccggtggcttacaggggtaggaaggaccttggagtccacaccatgtagacctgaaatactaatggccctcctagacaggaggctcatgagagtggtagggctaaagcctaacactgtgcaatgtctgcaatttcctctgctttttcaaatacaattgtctttttccccaaaacccacaccacctattctcctgttttctctgtgtgtgttctgaaacggccttgtgtgcccaccacactgtctacctcaggggcaagtctgtctctcttctttcactttgtatgccacgcaacttccttctctacgttaaacacacactccctgttattcgttcacccatggctcttgttgcatttgtacagcagcagagaaacaggctcccttgcagatgtccattggctcattgccaggatagacactaattagaaccccagttcttccagctccttatgacttaccatacacttttcatccctgttatgctccagggtcaagtttttggtggcttttgaagcagtttttatggctgcataggacatcactctgtggttctttaaggatctcacctacttgctttttttgagttagcaccccctttgggaggagagaaaattcttcctttgccatttgtgggctcttatcccaagctccgagttctccaaagattcctctttatgtcaagagggcaaataaacattgctgttttgaatcccagggctgctgtttatgtgagcatatgaaggttttccgtcagtattcctcatgcttcctcccactttctcctatagcagaggggttgtcctgtctactcaagcatttcttctggatattaccccaggaggacagggaacctctaatacaaaattttctccattcctctaatcacttccataccctcctcaatgtgcttaaggactctcaaggtcatatttaaagggagggaagtgcagcctcttgcagcagttggctgaaaaacaagcttctcatctacttaaagaacatgggaaatggattataaaaaaaaaagaggtaatcattttgttgccagaatgctgtgagtaagagtcactataagatcatggagataaggatataggccagcccaaggctgcaggtgcaagagacaaagtacccataggacagagagagataaaggctggtcacaggccacaggcacagaacagattaccattagaacagagatgaaggcaagcttaggggtacctggtaagaccggtttattctgaaactccaaggataaataggggacccctgttcacttgggtatttcctctgttctcaagtgggtaattgtgatgagatgggacacaggtttgggtacccagtaagacaggttcattctggaaccctaaggatgaatgggggatgccctgttcaggaaaggataatagggaaataaaaggagataccttctttttcctttttttctcctttgttgtatcttcacagatgggtaatcacatctccctactacagtacaaaccctttggatgcatcctcaagaactgaaagtttgaccccaaaaccctgaaaaggaaaaggctaatatttttctgtatcacagcctggttttaatacaagctccaggagcaggaatcttgaccagaaagtggaagcataaattttaaatttttaatatgctctatcagctagatctgttttgccactagcagggaaaatagacagaaatcccctatgtacaggccctaagaaacaacccagacctttgttgggcttgtaaaattgatccagtgatgatagcagccataatcatgctgccccatctggttggttcgggagacccctcattgggtttacccagggctcaagccctggaggaaccaagagtggagcttagctcaaaccctaccctttggccccattatatccaagtctcctggccctggagccttcccttccctacccagggccatcctctggacaccaccccctcaagttatgctcccttcaagaagttagttgacctactagagttcagactccatttaatatgcaagacctgagtcaaattaaaacagaactagggaagtttatggaggatcctgacaaatgcatcaaagggttccataaactgggcttaacatttgaactcacttggagggatctctcagtcatactgggacaaaccctgtctaagggagaacatgactccattatggaggcaccccaaaaatttgcaaatgcaatacacatgactgaccttggtggctaccctgtatgggccaccacagttcactgggtcagccccaattgggattacaatacccatgggggcatatgggcaaagaattgcatgttcttatgtctcgtagaaggaatgaaagctagaagagccaagcctgtaaactataataaaattggtcttaatagatcaaggacctcttggaaaccccaccactttcctagagaggctacaagaggccctggtgaaacacactaacctagacccagagacatcacaagggcaactggtcctgaaggaccattttttaactcaggcagccccacatatttggaggaaactctaaaaactagcactggaccccaaaacccttatgcctgacatcttcaacatagcttcctctgtcttttacaaccaggactaggagaaagaggaaagggctcagggaaagaagaggtaaaaggaaaagcagcagctccaactattggctgccctaaaaatccaccagccctctccaagttgccctcagaatactctcccagttaactgccatcagtgtgggaagccaagacactggaagacaaactgccgcagtgggacagatgggaaaaatccctacatggcttgccctttctgtcacaaactcaaccactggaaatggaactgccctgagggctgaagggcccctagaacagaatcccaattcctgatggccttaagctgaaaaggcccgccactccagcagctcctggactgaacattactattgaagggacagagctaagggctgctttggatgtggcaggtaggactataagttttctttgggaaatggccttcttggtgcttatgtcttcatgggcaattatcctccaaggtgatggggttaaattgggtgcccataacccaaaggttcactcctcatctttgctgcctgtgaggggagactgtcttttctcattcatttttaatgatagcagaatgtcctacactgcttttgggtagagatattttatttagactaggggcttagttaaccttttccaaatgcaatcttatgcctcaaggaagtcacacacaaggatgaacttcccagacttttccattaatccagaagtctggggctcaagaatatcaggaaaggtcataatgataatgcctatagtaactcagctcatggatccttctagctaaccttgtagaaggcagcttcctctttgacctctggccaaaagggacttcatcccctaattgaaaaatgtctaaaacatggattattaatatactataactcgctatgtaacacccctgtcttacctgttaaaaagagcaatggagcaatggacaatataggctagtccaggacctgcaaatcataaatgaggcagtagtcccaatacacccaatggtccccaacccatatattattctaggagaagtacccccagatgctcatttgttctcagtcttagagctcaaagatgctttcttttgtgtctccctagactcatcctcccaatttgtatttgcacttgaattggggaatgaaaaaggaaggagtctacagctaatctggatagtacttccgcaaggttccagagatggttccaatttgtttgggcaagtcttggctagagatttgcaggacctaactcttgagggttgagggtgtctcctacagtacatagatgacagatgacctgttaatctgctcccctacaagagagttatgaatcctgcatctagtccagacactagattttctcacagagggtacaagatgtctaaggccaaggcacatcgattaagaaaagaggtttaatacctggggataatcctgatcccacagagaacataagctttctccagaatggatacaggccatccttagaatacctaccccaaccacctaaaagcaactttgggcttttctggggatcacaagatattccagactttcaatactggcatatggtggaattattaagtccttatatcaggttctaaaagaagggactcatcaggacccacttctctgggaaaaagatcagaagcaagcctttagagaactaaaaactgccttctcacaagccctagcccttgggctacccatactaaccaaaccgtttcagcttttcatcactgaaagtaagctgtagccctggaagttctaactcaaaccatcaggccatcaaatgtcctataggttactttttaaagaacctagacccagtagtgcaagggtggccacactgcctaaaggtagtggctgcagcagcccttttacccaaggaggccctcaaaatcacaatgggacagtcggtcaggctcctgacattccaactaataggccccttattggatataaaaagaccgcaatggatcactgacaacagactgctaaactaccaagtcttgttgtcagaaaacccacaggtaacagttgagtggtgttccactcttaacccagcctccttactgccactactagaagaggataactgaacacattcatgttgtgagatacttaaccaaatttatgccagccaggaagacttacaatatcagcccctaggttatctagatgaaatatggttttcagataggattggctttgtcaagaatggagatagatatgcagggtatgctatatgtcccttcacccagttacagaggtggtagctctgtccctggggacctcagtgcaactagctgacccatcacattgaccagggccctaaaacttggggaaagaaaaagaataaccacatatacagattccaaatatgccttcctggtgcttcacacccacatggctaaccagaaggaagggggatacctaacagcttggaatactcctattacatagagacctccaatcttagagctactagaggctgttcatttgcctcaggaagtggcagcagtgcactgtaaagaataccacaggggttctgatgaaactgcatggggaaatatgttatctgaccaaaaagctaaagaggcagccatctcaaaagacacctctgtggggactttactcccctctctccccagtgaactgcccttctccaatacactaaggaagaaatagattgggccatccagcatgggtataaagaagaaaccaatggatggtacatgttgggagaacttctccatctacctaatgcttcccagtggaaagtcatcaagtgtttacttgactcatgccaccttgaaaaggacagtctagggtaaatttgtaaatgggtgttcagtgggaagggactaaccaaaattattcaataggtttgtcaagcctgcaccttgtgaaccacaaataatccctagatggggaagccccctccataataagtcaaatccaaaggagaggtacatactctggggaggactggtagatggacttcactcagctacccacatgccacaggtgtaagtacctcttggtctgtgtaggtaccttcacagaacgggaagactcctgccccacaaggactgaaaaggcacaggagatagctgacttgctcctaaaggaactcattccctgctttgaactccccaggtcattgcagagtgacagtgattcatctttttttccccaagtaacttaacaggttagtaatgccctaggcatgaagtggtaccctcactttgcctgagaactgcaatcttcaggaaaagtggaaagaatttaccaaaccctgaaatgcatcctcaataatctctgtcaggaaatagcagtcatgggtggacctcttacctttaaccctccttcaaatctgtattgcccctaaggctccctagcaattaagcccctttgagatcttatattgtaggccatttctatattcagacttatctgatactagatgaagaaactgccaaaatcacccagtatgtttcttctttagcaggcttccaacagactctctgggaatatgggttaaaaacaaacccaacgtcggaaggggaaacaatcccagcctctgtatcttccaggctctagttctcattaaagcttggaaggttgaaaccccaaattcctaactaactgtattctgggggggccacttcactgctccagtatctattcccacagccattaaagtaccagagatagccagctggatacatcatgcctgggtgaagtcatggaaaggccatgcaacaccagagccagaaccaacaccctcagctccagaatacacttgtgaggcactggaagacctgaaattcctcttttagtgaaaacataagtaatgccccctcaacatcctttcacctcaaagtaaggtgatcctagtattaggaattttactaacaattgttatgattattatcactattttaatcccaacttgtacaccaccaggagttccagtggcagcttgctttgtgatcaatttctctctctcacaatcaccttaggtcaccatggctctgctcctgttggttctcatactcaacgctttactggcagcacactgccatcctgatttcctgttatgagaaaaagctcagcaattgctccaaaacacaggatccccttactccaccaaatgctggttatgtactagctcttcctctaaaacaccagggagagcttatccagcctgtaccagagattggacaagcatagacatagagttacgtatttcctctcaacaggaccctaatctgaaagagctatttgggtctgcaaataacattttttgcaaaagcaaagcagtatttacttgacatccacaaggcacctctcatttttggatcaatcttttctaatatcactttaatgggaataacctctatttgtcttatggccaaaagaaaaagatggattggatgtaggctctttcccagtatagcttgtaatgttactctctctgtagattctaaccaacagactgatggaacatacaccgaaaaccaattccaccatcaaccaagattccccaaaccttcaaatattatctttcttcaggcaactttgctaattaagtccattcagttttgccagcaatgcccaagctcatgcagtacttgaaatttctagttccagcctgatgattataaccaatgtctgcaaattgccaacctcagctccacagcagaatgggttctaatggagtaaactcaaaattctctttttttgggaaaatgaaaccaagggagctaatcagagccaaaccccatgtacccaagtgttagcaggcatgaatgtagctaccagctacctgggtgtgttgtcatccttggtatttttgggggctgtcctcatctcttcttttgttttgacatctctacttgtcttaaaacccaaggagccttctgtgtttgtggccaatcagtttaccaatgcctcctcattaaatggactggaacttgtaccatagattatgtacccctggacatctttatactccctggcaatctctctcttccagcaccaatccatgggaattctatcttgcccagggtgaaaagggctatccaattaattccccttcttatgggcctcagcattatagctggtatgggaacctaaactgccggaatctcaaaagcctccttgacctatagccaactctgaaaggaaatagccagcaagtttaatatcatggctaaaacctcaaccatggccagagcaaattaacactttagcagttgtagtcctccaaaactgtcaaggactagatatgttaatggcagcacagggaggaatttgtttagctttagatgaaaaatgttgcttttgggtaaatcaatcagtaaaagtacaaaacaacatcagacaactcctaaatcgagcctccagcttacaagaacaagcctctcgtggttagttagattggtaaggaacctggaaatgggatcttccctgggttcttccctttttaggcccacatgttagcctctacttttgctcctttcagtccatgtcttcaaaaatctaataacccaatttgtctcctttctctcacctttagatgatcaagttccagatgatcctcagtgagggataccatcctttcaatattcaagagtcacccttctacagaggactcctagacttcccatcagtgggacatggcagaggtgaaatcctgcccctgtctcccttagacctggctggatactgcttccaacaacccatgcagccaccctgccctgacagctagcaagaggccaagacccacagaacaatcaccatcacacctctgtcagcaggaagcagttacagaagactgaccttcatccagtttcccaaagaattgggtcatggatttttgcgggggaaaatgttagagtaggtaattaggcagacatgagtaagggaggagagaccccctccaactaggaatgtcaggtgagcatcagatgatcatcaggtggttgttaaactctctctctaaaataataataggttgcaactggcagcagggaaagacaatctcccaatagatagaaaagtcctgaagctggtgatcagcagcttcctagtaagatctcaggatttgggcaagcaggctcaaacatgggcactaagaggcaaaatcgtggagtttaactggtatacagacttcctctaaaaacacatgactcatgcacatgtggacagcctgccccaaggaaaaatcaaaagaggagagatgcaaaaccccagaagcatgccaatatataaaaccccaagtctaaggtcaaacagggcacttggatttctcaagttgcccacttggccctcttctaagtgtactttatttcctttcattcctgctctaaaactttttaaatttcactcctgctcaaaaacttgcctcagtctttcactctgccttatgccccttggaagaattatttccttcaagatggcaaaaagcaagctgctgcagacccatacagatttgctgctgctaa

SEQ ID NO: 162 - DNA, 974 bp, Homo sapiens; identical to SEQ ID NO: 82

SEQ ID NO: 163 - DNA, 392 bp, Homo sapiens
gtcaggcctctgagcccaagctaagccatcatatcccccgtgacctgcacttatacatccagatggcctgaagtaactgaagaatcacaaaagaagtgaaaatgttcctgccttaactgatgacattaccttgtgaaattccttctcctgtctcatcctggctcaaaagatcccccactgagcaccttgtgacccccacccctgccagccagagaacaaccccctttgactgtaattttccactacctacccaaatcctataaaacggccccacccctgtctccctttgctgactcttttcagactcagcctgcctgcacccaggtgattaaaaagctttactgctcacacaaagcctgtttggtggtctcttcacatggacgtgtgtgaaa

SEQ ID NO: 164 - DNA, 6501 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccctgtgctctctgaaacatgtgctctgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaagaaggcatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgaaatgtttatgtgtatgcatatctaaaagcacagcacttaatcctttaccttgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttctttctttctctatactttgtctctgtgtctttttcttttccaaatctctcgttccaccttacgagaaacacccacaggtgtgtaggggcaacccacccctacatctggcgcccaacgtggggcttttctctagggtgaaggtacgctcgagcgtggtcattgaggacaagtcgacgagagatcccgagtacttctacagtcagccttacggtaagcttgtgcactcggaagaagctagggtgataatggggcaaactaaaagtaaagttaaaagtaaatatgcctcttatctcagctttattaaaattcttttaaaaagagggggagttaaagtatctacaaaaaatctaatcaagctatttcaaataatagaacaattttgcccatggtttccagaacaagaaactttagatctaaaagattggaaaagaattggtaaggaactaaaacaagcaggtaggaagggtaatatcattccacttacagtatggaatgattgggccattattaaagcagctttagaaccatttcaaacagaagatagcgtttcagtttctgatgccactggaagctgtataatagattgtaatgaaaagacaaggaaaaaatcccagaaagaaaccgaaagtttacattgcgaatatgtagcagagccggtaatgactcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaacgcaggttaaagaaaataagacccaaccgccagtagcctatcaatactggccaccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcgaaagagccctaccctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagctactaccacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaaaaaccccccctccctgtcccaagtgtttcagggaataagccagttaccacaatacaacaattgtcccccgccacaagcggcagtgcagcagtagatttatgtactatacaagcagtctctctgcttccaggggagcccccacaaaaaatccccacaggggtatatggccccctgcctgaggggactgtaggactaatcttgggaaaatcaagtctaaatctaaaaggagttcaaattcatactggtgtggttgattcagactataaaggcgaaattcagttggttattagctcttcaattccttggagtgccagtccaggagacaggattgctcaattattactcctgccatatattaagggtggaaatagtgagataaaaagaacaggagggtttggaagcactgatccaacaggaaaggctgcatattgggcaagtcaggtctcagagaacagacctgtgtgtaaggccattattcaaggaaaacagtttgaagggttagtagacactggagcagatgtctctatcattgctttaaatcagtggccaaaaaattggcctaaacaaaaggctgttacaggacttgtcggcataggcacagcctcagaagtgtatcaaagtacggagattttatattgcttagggccagataatcaagaaagtactgttcagccaatgattacttcaattcctcttaatctgtggggtcgagatttattacaacaatggggtgcggaaatcatgcccgctccattatatagccccacgagtcaaaaaatcatgaccaagatgggatatataccaggaaagggactagggaaaaatgaagatggcattaaagttccagttgaggctaaaataaatcaagaaagagaaggaatagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcattctcgccttggaattctcctgtgtttgtaattcagaagaaatcaggcaaatggcgtatgttaactgacttaagggccgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatattaagaggagactcagacttaaatagtaaaagaatattaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaaatgactacttggattctacctaaaattaccagacgtgaacctttagaaaatgctctaacagtatttactgatggttccagcaatggaaaagcagcttacacagggccgaaagaacgagtaatcaaaactccatatcaatctgctcaaagagcagagttggttgcagtcattacagtgttacaagattttgaccaacctatcaatattatatcagattctgcctatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaagaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcgtatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccacggagatggtaacacc

SEQ ID NO: 165 - DNA, 5714 bp, Homo sapiens
tcacaaaagaagtaaaaatggctggttcctgccttaactgacgacattaccttatgaaatttcttctcctgtctcagaagctcccccactgagcaccttgtgattcccgcccctgcctgccagagaacaacccctttgactgtaattttcccttacctacccaaatcctacaaaactgccccacccctaactccctttgctgactcttttcagactcagcccgccagcacccaggtgaaataaacagccttgttgctcacacaaagcctgtttggtggtctcttcacacggacgcacgtgacatttggtgccgaagactcgggacaggaggactccttcaggagaccggtcctctgtcctcaccctcactctgtgaggagatccccctacgaccttgggtcctcagaccaaccagcccaaggaacatctcatgaatttcaaattgggtaagtggtcttttcactctcttctccagcctctcttgctatccttcaatctccctcttttgctacccttcaatctccctgtccttccaattccagttctttttcctctctagtagagacaaaggagacacattttatccatggacccaaaactccagtgctggtcacggactagggaagacagtgttctgttggtgtttaatcactgcagggacgcctgcctgattcttcacccacactccattggtgtctgatcactgaggggatagctgccttggtcattcacccacgttctcttggtggcaagtcaattgctgggatgcttgctttggctgctcacacacattgcagcccagggctgctcaccacccctcttctctgtgtctctaccctctcttttctctgggcttgcctccttcactatgggcaaccttccaccctccattcccccttcttctcccttagcctgtgttctccaaaagttaaaatctcttcaactctcgcctgacctaaaacctaagcatcttattttcttctgcaacactgcttggcaccaatacaaactcgataatggttctaaatagccagaaaatggcacttttgatttctccattttacaagacctggatgatttttgtcgaaaaaatgggcaaatgggtctgaggtgcctgactgccaggcattcttttacacattggtccctccctcatctctactcccagtgtgactcatcgcaaatctttcttctttctctcctgtctgttccttcagtctccaccccaacctctgagtcctttgaatcctccttttctacagaccaatctgaccactcccctcttccccaggctgctcctccctaggccaagccatgtctcaattcttcctcagcctccgctctcccaccctataatccttttatcacctcccctcttcacacccagtccggcttagtttctttccgaaactagctgtcccccacctgcccaacaatttcttcttaaagatgtggctggagctgaaggcatagccaaggtcgatgtccctttttctttatccgacctctcccaaatcagatagtgttcaggctctttttcatcaaatataaaaactcaacccagttcatggcccatttggcaacaacccttagacgctttaccaccctagacccagaagggccagaaggccatcttattctcggtgtgcattttattacccaatccactcccgacattagaaaaagctccaaaaattaaattccggccctcaaaccccacaacaggacttaattagcctcaccttcaaggtgtacaataatagagtagaggcagccaagtagcaatgtatttctgagttgcaattccttgcctccactgtgagacaaaccccagccacatctccagcacacaagaacttccaaacgcctgaaccacagtggccacgcattcctccaggactgcctgcccgaggatcttgcttcaagtgccagaaatctggcactgggacaaggaatgcctacagcctggaattcttcctaagccatgtcccatctgtacaggaccccactggaaatcggactgtccaactcacccggcagccactcccagagcccctggaactctggcccaaggctctctgactccttcccagatcttctcagcttaacggctgaagactgacgctgcccaatcacctcggaagcctcctagaccatcacagacactttgggtaactcttacagtggagggtaagtccgtccccttcttaatcactacggaggctatccactccacattaccttcttttcaagggcctgtttcccttgcctccataactgttgtgggtattgacagccaggcttctaaacctccccaactctgatgcgaacttggacaacattgttttatgcactccttcttagttatccccacctgtccagctcccttattaggtagagacattttaactaaattatctgcttccctgactattcctaggctacagccacacctcattgctgccctttttccccagttcaaagcctccttcacatcctccccttgtatctccccacctcaatccacaagtatgggacacccctactccctccttagtgccgaccatgcaccccttaccatcctattaaaacctaatcacccttactccgctcaatgccagtatcccatcccacaacaggctttaaggggattaaagcctgttatcactcacctgctacagcatgggcttctaaaacctataaactctccttacaattctcccattttacctgttcaaaaaccggacaagtcttacaggttagttcaggatctgcaccttatcaaccaaattgttttgcctatccaccctgtgttgcccaacccgtacactcttttgtcctcaataccttcctccacaactcactattccgttcttgatcttaaagatgcttttttcactattcccctacacccctcatcccagcctctctttgcttttacctggactgaccctgacacccatcagtcccagcagcttacctgggctgtactgccacaagacttcagggacagccctcattacttcagccaagctctttctcatgatttactttctttccaccccttcgcttctcaccttattcaatatatcgatgaccttctactttatagaccctcctttgaatcttctcaacaagacaccctcctgctccttcaacatttattctccaagggatatcgggtatccccctccaaagctcaaatttcttctccatccgttacctaccttcacataattcttcatgaaagcacatgtgctctccctgctgatcatgtccagctaatctcccaaaccccaacaccttctacaaaacaacaattcctttccttcctacgcatggttagggacttctgcctttggacacctagttttaccatcctgactaaaccattacataaactcacaaaagcaaacctagctgaccccacagatcctaaatcttttcgccactcctctttctgttctgtaaaaacggccctagaagctgctcccacactaactctccctaactcatcccaacccttttcattacacagagccaaagtgcagggcagtgcagtcaaaattcttacacaagagctgggaccgcaccctgtagcctttctgtccaaacaacttaaccttactgttttgggctggcctccacccccatgactgtatctttctgatccacctggcattcactccatttccccatatttccttctttcctgttcctcacactgatcacatttagtttattgatggcagttccaccacacctaatcacccctcaccagcaaaggcaggctatgctatagtatcttccatatctatcattgaggctaccactctgccccactccaatacctctcagcaagccaaactctttgccttaactcgagtccacactcttacaaaaggattacaggtcaatatttatactgactctaaatatgccttccatatcctgcaccactgtgctgttatatgggctgaaagaggtttcctcactatgcaagggtccaccatcattaatgcctctttaataaaagctcttctcaagaccactttacttccaaaggaagctggagtcattcactgcaagggccatcaaaaggcatcagatcccatcgctcaggacaacaactatgctgataaggtagctaaaaaagcagctagcattccaacttctatccctcatggcagtttttctccttctcattggtccctcccacctactcccccactgaaacttccacctatcaatctctttccaaacaaggcaaatggttcttggaccaaggaaaatatctccttccagcctcacaggcccattctattctgtcatcatttcataacgtcttccatgtaggttacaagccactagccaacctcttagaacctctcatttcctttccattgtagaaatatatcctcaaggaagtcacttctcagtcttccatctgctattctactactcctcagggattgttcaggccccctcccttccctacacatcaagctcagggatttgcccctgcccaggactggcaaattgactttactcacatgccccgagtcaggaaactaaaataccccttggtccaggtagacactttcactggatgggtagaggcctttcccacagggtctaaaaaggtcaccacagtcatttcttcccttctgtcagatgtaattcctaggtttggccttcccacctctatatagtccaataacgggcccacttttaatagtcaaatcacccaagcagtttctcaggctcttggtattcagtaaaaccttcataccccttactgtcttcaatcttcaggaaaggtaaaactgactaatggtcttttaaaaccagacctcaccaagctcagcctccaacttaaaaaagaggactctgtcaacgatagagcccaaaaacttgccaaccaagcaaataatcacactaaacccccttgagcactctctaattaaatgtcctgggtcctcccaattcttagtcctttaatatctgtttctctccttctcttatttggaccttgtgtcttctgtttagtttctcaattcatacaaaaccatatccagaccatcaccaataattctacatgacaaatgatccttctaacaaccccacaatatcaccccttaccacaaaatcttccttcagcttaatctctcccactctaggttcccatgccgcccctaatcccactcaaagtagccctgagaaacattgcccattatctctcataccatccccccaaaatttttgctgccccaacacttcaacactattttatgttatttttcttattaatacaagaagacaggaatgtcaggcctctgagaccaagctaagccatcatatactctgtgacctgtgcatatacatccagatggcctgaagcaagtgaagaaacacaaaagaagtaaaaatggctggttcttgccttaactgacgacattaccttgtgaaatttcttctcctggctcagaagctcccccactgagcaccttgtgacccccgcccctgcccgccagagaacaacccctttgactgtaattttccattacctacccaaatcctataaaactgccccacccctaactccctttgctgactcttttttcaggctcagcccacctgcacccaggtgaaataaacagccttgttgctcacacaaagcctgtttggtggtctcttcacacggatgcatatga

SEQ ID NO: 166 - DNA, 5733 bp, Homo sapiens
gtcaggcttctgagcccaagctaagccatcatataccctgtgacctgcacgtatacatccagatggcctgaagtaactgaagaatcacaaaagaagtgatatttaaattgcctgttcctgccttaactgatgacattccaccacaaaagaagtgaaaatggccagtccttgccttaactgatgacattaccttgtgaaattccttctcctggctcatcctggctcaaaaagctcccccattgagcaccttgtgacccccactcctgcccgccagagaataaccccccttcttcctttacctacccaaatcttataaaatggccccacccctatctcccttggctgactctcttttcggactcagcctgcctgcacccaggtgaaataaacagccttgttcctcatacaaagcctgtttggtggactcttcacacagatgcgagtgaaatttggtgccatgactcggactgagggacctcccttgggagatcaatctcatcctcctgctctttgcaccatgagaaagatccacctacgacctcaggtcctcagaccaaccagaccaaggaacatcacaccaattttaaatcaggtaagtggcctcttcttactctcttctccaacctctctcactatccttcaccctctttctcctttcaatcttggtgccacacttcaatctctcccttctcttaatttcagttccttttcttttctcatagagacaggagacgtgttttatccatggacgcaaaactctggcgccagtcacagactcgggaagacaatcttcccttggtgtttaatcacacagggacgcctgcctgattattcacccacatttcagaggtgtctgaccatgcggggacacctgccttggtccttcacccttagcggcaagtactgcttttctggggggcaagaaccccccgaccccttctctccgtgtctctaccccttctccgcttttctagggggcaagaacccctcaaccccttctctccgtgtctctactctctcttttctctgggcttgcctccttcactatgggcagccttccaccctccattcctcctccttctcccttagcctgtgttctcaagaactcaaaacctcttcaactcacacctgacctaaatgccttattttcttctgcaatgccgcttgaccccaatacaaactcaacagtggttccaaatagccagaaaacagcactttcgatttttccatcctacaagatctagataattcttatcgtaaaataggcaaacagtctgaggtgcctgacgtccaggcattcttttacacattgttccctccctagcctctgttcccaatgtgacatgtcccaaatcctccttctttccctcccgcctgtcctctcagtcccaatcccaagcgtcactgagtttttctaattctccttttctacagacccatctgacttcacgcctcctccccaggctgctccttgccaggctgagccaggtcccaattcttcctcagcctctgctcccccaccccataatccttttatcacctcccctcctcacacccagtctggcttacagtttcattctgcgactagccctccccgacctgcccagcaatttcctcttaaaaaggtggctggagctaaaggcatagtcaaggttaatgctcccttttctttatccgacctctcccaaaatcagttagcatttaggctctttttcatcaaatatgaaaaacccagcccagttcatggctcattcggcagcaaccctgagatgctttatagccctagaccctaaaaggtcaaaaggctgtcttagtctcaatatacattttattacccagtccgctcctgacattaaataaaactccaaaaattaaattccggccctcaaaccccacaacaggacttaattaacctcaccttcaaggtgtacaatagagtagaggcagctaagtagtaacatatttctgagttgcaattccttgcctccactgtgagacaaaccccagccacatctccagcacacaagaactccaaatgcctgaaccgcagctgccaggggttcctccagaaactcctcccccaggagcttgctacaagtgccggaaatctggccactgggccaaggaatgcccacagcccaggattcctcctaagccatgtcccatctgtgcaggaccccactgaaaatcgggctgttcaactcacctggcagccacttccagagtgcctggaactctggcccaaggctgtctgactccttcccagatcttctcggcttagcagctgaagactgacgctgcccgatcacctcgggagtttacaggaccatcacagacgatctgggtaactctcacggtggaagataagtccgtccccttcttaatcaatacggaggctcccactccacattaccttcttttcaaggacctgtttcccttgcctccataactgttgtgggtattgacggccaggcttctaaacctcttaaaactctggtgccaacttagacaatactcttttatcactcttttttagttatccccacctgcccagttcccttattaggccgagacactttaaattatctgcttgcctgactgttcctggactacagccacacctcattgctgcccttttccccagttcaaagcctccttcacatcctcctctcctatccccgcaccttaacccacaagtataggatacctctactccctccttggagactgatcatgcaccccttaccatcccattaaaacctaatcacccttaccctgctcaaggccaatatcccatcccacagcatgctttaaaaggattaaagcctgttatcactcgcctgttacagcagcatgggcttttaaagcctacaaattccccttaaaattcacccattttacctgtcctaaaaccagacaaggcttacaggttagttcaggatctgtgccttgtcaaccaaattgttttgcctatccaccccgtggtgccaaaccgatatactctcctattctcaatacctccctccacaacccattattctgttctggatctcaaacatgctttctttactattcctttgcacccttcatcccagcctctcttcgctttcacttggactgaccctcacatccatcaggctcagcaaattacctgggctgtactgccgcaaggcttcacagccagcccccattacttcagtcaagcccaaatttcttcctcatctgttacctatctcagcgtaattctcataaaaacacacgtgctctccctgccgatcgtgtccgactgatctctcaaaccccaacaccttctacaaaacaacaactcctttccttcctaggcatggttggatactttcgactttagatacctggttttgccatcctaacaaaaccattatataaactcacaaaaggaaacctagctgagcccatagatcctaaatcctttccccactcctctttccattccttgaagacagctttagagttggcccccacgctagctctccctgactcatcccaacccttttcattacccacagccgaagtgcagggctgtgcagccagaattcttacacgagaaccggaactgcgccctgtagcctttttatccaaacaacttgaccttactgtcttgcctagccctcaaatctgcatgcggcggccaccaccgcactaatacttttagaggcccttaaaatcacaaactatgctcaactcactctctacagttctcataacttccaaaatctgttttcctcctcacacctgacacatatactttctgcttcccggctccttcagctgtactcactctttgttgagtctcccacaataaccattgttcctggcgtggacttcaatctggcctcccacattattcctgataccacacctgacccccgtgactgtatctctctgatccacctgatattcaccccgtttccccatatttccttctttcctgttcctcaccctgatcacacttgatttattgatggcacttccaccaggcctaattgccacacaccagcaaaggcaggctatgctatagtacaagccactagcccgcctcttagaacctctcatttcctttccatcgtggaaatctatcctcaaggaaataacttctcagtgttccatctgatatcctactattcctcagggattattcaggccccctcctttccctacacatcaagcgtgaggatttgcccccgcccagggctggcaaattggctttactcaacataccccgagtcaggaaactaaaatgcctcttgttctgggtagacactttcactggataggtagaggcctttcccacagggtctaagaagaccaccacggtcatttcttcccttctgtcagacataattcctcggtttggccttcccacctctatacagtcctataacggaccagcctttattagtcaaatcagccaagcagtttctcaagctcttattcagtgaactaatggtcttttaaaaacacacctcaccaagctcagccaccaacttaaaaaggactggacaatacttttaccacttgacctcagaattcaggcctgtcctcagaatgccacaaggtacagcccatttgagctcctgtatagacgctcctttttattaggccccagtctcattccagacaccagaccaagttggactgcggcgccctcccccccgcaaaaaaaacaaaacttgtcatccctactatcttctgtctaatcatactcctattcgccgttctcaactactcataaatgccctgctcttgtttacactgctggtttacactgtttctccaagccatcacagctgatatctactggtgctatccctaaatcaccactcttaactccctcttaaagtaaataaataatctttgctggcagggctatgctgaacctccttgggcactctctagttagatgtcctgggtccttccaattcttagtcctttaatacctgtttttctccttgtcttattccgttcttttttcaaatcatacaaaaccatatccaggccatcaccaataattctatacgacaaatgtttcttctaacaaccccacaatatcaccctttaccacaaaatcttccttcagcttaatctctcccactctaggttcccacaccacccctaatcccgctcaaagcagccctgagaaacatcgcccattatctctccataccaccccccaaaaattttcgccgccccaacacttcaacactattatgttttatttttcttattaatataagaagacaggaatgtcaggcctctgagcccaagctaagccatcatatcccctgtgacctgcacgtatacatccagatggcctgaagtaactgaagaatcacaaaagaagtgatatttaaatagccggttcctgccttaactgatgacattccaccacaaaagaagtgaaaatggccagtccttgtcttaactgatgacattaccttgtgaaattccttctcctggctcatcctggctcagaaagctcccccactgagcaccttgtgaccccccactcctgcccgccagagaacaacccccctttttcctttacctacccaaatcttatagaacggccccacccctatctcccttcactgactctcttttcggactcagcctgcctgcacccaggtgaaataaacagccttgttgctcacacaaagcctgtttggtggtctcttcacacggacgcgtgtgaaa

SEQ ID NO: 167 - DNA, 5839 bp, Homo sapiens
caggcctctgagcccaagccaagccatcgcatcccctgtcacttgcacgtatacacccagatggcctgaagtaactgaagaatcacaaaagaagtgaatacgccctgccctccttaactgatgacattccaccacaaaagaagtgcaaacggccggtccttgccttaactgatgacattaccttgtgaaagtccttttcctggctcatcctggctcaaaaagcacccccactgagcaccttgcaacccccactcctgccctccagagaacaacccccctttgactataattttcctttacctacccaaatcctataaaacagccccacccctaactcccttcgctgactctctttttggactcagcccgcctgcacccaggtgaaataaacagccacgttgctcacacaaagcctgtttggtggtctcttcacacggatgcgcatgaaatttggtgctgtgactcggattgggggacctcccttgggagatcaatcccctgtcctcctgctctttgctccatgagaaagatccacctatgacctcaggtcctcagactgaccagcccaagaaacatctcaccaatttcaaatccggtaagtggcctctttttactctcttctccaacctccctcactatccctcaacctctttctcctttcaatcttggcgccacacttcaatctctcctttctcttaatttcaattcctttcattttttggtagagacaaaggagacacattttatccgtggacccaaaactccggcgccggtcacggactgggaaggcagctttcccttggcgtttaatcattgcagggacacctctctgattattcacccacgtttcaagggtgtcagaccacgcagggatgcctgccttggtccttcacccttagcagaaagtcccgcttttcaggggaaggggcaagtaccccaaccccttctctccttgtctctaccccttctctgcttttccagggaaaaggcaagtaccccttctctccttgtctctaccccttctctgcttttctggggaaagggcaagtaccccaaccccttctctccatgtctctaccccttctctgcttttctgggggaggggcaagtacccctcaaccccttctccttcacccttagcggcaagtcctgctttcctagggggcaagaactccccaatcccttatttctgaaccccgacctcttatctctgtgccccaatcccttatttctgaaccccaacctcttatctctgtgccccaattccttatttccatggcccaaccctttctctgcttttctggagggcaagaaccccccacctcttcctgtgtctctactcttttctctgggcttgcctccttcactatgggcaagtttccaccttccattcctccttcttctcccttagcttatattcttaagaacttaaaacctcttcaactctcacctgacctaaaatctaagcatcttattttcttctgcaatgccgcttgaccccaatacaaacccgacagtagttccaaatagccggaaaatggcgctttcaatttttccatcctacaagatctaaataattcttgtcataaaataggcaaatggtctgaggtgcctgatgtccaggcattcttttacacatcagtcccttcctagtctctgtgcccagtgcagctcatcccaaaccttccttctttccctcctgcctgtcccctcagtcccaaccccaagcgtcgctgagtctttctaatcttccttttctacagacccatctgccctctcccctcctcgccaggccaaactaggtcccaattctccctcagcctccactcctccaccctgtaatctttttattacctcccctcctcacacctggtcctgcttacagtttcattctttgactagccctcccccacctgcccagcaatttactcttaaaaaggtggttggagccaaaggcatagtcaaggttaatgctcctttttctttatcccaaatcagaagcatttaggctcttttttatcaaatataaaaacccagcccagttcatggctcgttcagcagcaaccctgagacactttacagccctagaccctaaaaggtcaaaaggccatcttattctcaatatacattttattacccaatctgctcctgacattaaataaaactccaaaaattagaatctggccctcaaaccccacaacaggacttaattaacctcaccttcaaggtgtacaataacataaaaaagttgcaattccttgcctccactgtgagacaaaccccagccacatatccagcacacaagaacttccaaatgcctgaaccacagcggccaggcattcctccagaacctcctcccccaggagcttgctacaagtgccagaaatctgaccaccaggccaaggaatgcctgcagcccaggattcctcctaagccatgtcccatctgtgcgggaccccactggaaattggactgttcaactcacctggcagccactcccagagcccctggaactctggcccaaggctctctgactgactccttcttggcttagcggctgaagactgatgctgcctgattgcctcagaagcccggtagaccatcacggatgccgagctttaagtaactctcacagtggagggtaagtccattcccttcttaatcaatacagaggctacccactccacattaccttcttttcaagggcctgtttcccttgcctccataactgttgtgggtattgacagccaggcttctaaacctcttaaaactcccaactctggtgccaaattagaggatactcttttatgcactcttttttagttatccccacctgcccagttcccttattaggctgagatattttaaccaaattatctgcttacctgactattcctggactatagccgcatctcattgctgcccttcttcccaatccaaagcatcctttgcatcctcctctagtattcccccaccttaacccagaagtataagatacctctactccctccttggtgactgatcatgcaccccttaccatctcattaaaacctaatcacccttaccccactcaatgccaatatcccatcccacagcatgctgtaaaaggattaaagcccgttatcacttgcctgctacagcatgggcttctaaaacctataaactctccttaccattcccccattttacctgtcctaaaaccagacaaggcttacaagttagttcagaatctgtgccttatcaaccaaattgtttcgtctatccaccccatggtgccaaacctgtatactctcctatcctcaatagctccctctactacccattattctgttctggatctcaaacatgctttctttactattcctttgcacctttcatcccagcctctctttgccttcacttagactgaccctgacacccattaggctcagcaaattacctgggctgtactgcctcaaggcttcacagacagcccccattacttcagtcaagcccaaatttcatcctcatctgttacctatctcagcataattctcataaaaacacacgtgctctccctgctgatcatgtctgattaatctcccaaacctcaatcccttaaaaaagagcaactcctttctttcctaggcatggttagtgcggtcagaattcttacacaagggccaggaccacacagtgtaggctttctgtccaaacaacttgaccttactgttttagcctagccctcatgtctgcgtgcagcagctgccactgctttaatactgttagaggccctaaaaatcacaaactatgctcaactcactctctacatttctcataacttccaaaatctattgtcttcctcatacctgacacatatactttctgctccccagctccttcagctgtactcactctttaagtcccacagttaccattgttcctggcccagacttcaatctggcctctcacattattcctgataccacacctgacccccatgactgtatctctctgatccacctgatattcaccccatttccccatatttccttcttttctgttcctcaccctgatcacgcttgatttattgatggcagttctaccaggcctaatcaccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgctgccactcaggactggcaaattagcttactcaacatgccctgattcaggaaactaaaatacctcttagtctaaatagacactttcactgaataagtaaaggcctttcctacagggtctgagaaggccaccacagtcatttcttccctcctgtcagacataattcctcagtttagccttcccacctctatacagtctgataacagaccagcctttattagtcaaatcagccaagcagtttttcaggctcttagtattcagtgaaacctttatatcccttacggtcctccatcttcaagaaaagtagaatggactaaaggtcttttaaaaacacacctcaccaagctcagctaccaacttaaaaaggactggacaatacttttaccactttcccttctcagaattcaggcctgtcttcggaatgctacagggtacagcccatttaagctcctgtatagatgctcctttttattaggccccagtctcattgcagacaccagagcaacttagactgtgccccagaaaacttgtcatccctgctatcttctgtctagtcatactcctatttaccgttctcaactactcatacatgccctgctcttgtttacactgccagtttacactgtttttccaagccatcacaggtgatatttcctggtgctatccccaaattgccactcttaactcttgaagtaaataaataatctttgctggcaggactctgctgaatctccttaggcattctctaatcagatatcctgagtcgtcccaattcttagaccttttatacctgtttttctccttctcttattccatttagtttctcaattcatccaaaaccatatccaggccatcagcaatcattctgtatgacaaatgtttcttgtaacatccccacaatatcaccccttaccacaagacctcccttcagcttaatctctcccactctaggttcccacacagcacctaatcccgcttgaagcagccctgagaaacatcgtccactctctctccataccacccccccaaaatttttgccaccccaacacttcaacactattttgttttatttttcttattaatataagaaggcaggaatgtcaggcctctgagcccaagccaagccatcgcatcccctgtcacttgcacatatatgcccagatggcctgaagtaactgaagaatcacaaaagaagtgaatatgccctgccccaccttaactgatgacattccaccacaacagaagtataaatggctggtccttgccttaagtgatgacattatcttgtgaaagtccttttcctgctcatcatggctcaaaaagcaccccccactgagcaccttgtgacccccactcctgcccgccagagaacaacctccctttgactgtaattttcctttacctacccaaatcctataaaacggccccacccctatctcccttcactgactctcttttcggactcagcccacctgcacccaggtgaaataaacagcctcgttgctcacacaaagcctgtttggcggtctcttcacatggatgcgcatgaaa

SEQ ID NO: 168 - DNA, 607 bp, Homo sapiens
cccccacaggaatgtcaggcagccatcaggtgatggtcaggcggttgttaagctgtctctctaaaatagacacacctgaagctggtgattggcagcttcctgataagattgcaggagttgggcaagtagactcaagcacatgcactaagaggcaaaatggtggagtttaactagtctatgaccttcctctaggaacactcaactactaaggggaaaatgcctcaagggagcatgtgcacagcttcagtgaacactctgtgcacggggcccctcccaagtgctggcaggccacactcctgtggatagcccaccccaagggaagaatccaaggagaagggagcaatcccccagaagcaggccaatgtataaaactccaagtcaaaggtcaaacagcgcacttgaatctctcaagtcacccacttagccctcttccaagtgtattttacttcctttcattcctgctctgaaactttttgataaactttcactcctgctctaaaacttgcctcagacgctccctctgccttaggtccctcagttgaattctttcttctgaggaggcaagaatttaagttgctgaaggcttgtatggattcgctgctgctaa

SEQ ID NO: 169 - DNA, 984 bp, Homo sapiens
gttggggaaagaaagagagatcagactgttactgtgcctatgtggaaagaagaagacataagaaactccattttgttctgtactaagaaaaattcttctgccttgagatgctgttaatctgtaaccctagccccaaccctgtgctcacagaaacgtactgtgttgattcaaggtttaatggatttagggctgtgcaggatgtgctttgtttaaaatgtgtttgcaggcagtatgcttggtaaaagtcatcaccattctccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaagacctctttgcagttgagataagaggaaggcatctgtctcctgctcgtcctggcaatggaacgtctcgctgtaaaacctgattgtacattctatttactgagataggagaaaaccgccttatggctggaggtgagacatgctggcggcaatactgctctttactgcactgagatgtttgtgtaaagtcaaacataaacctggcctacatgcacattgaggcacagcacctttccttaaacttatttatgacacagagacctttgcttacgttttcctgctgaccctctccccaccattagcctgtagtcctgccacattcccctcactgagatggtagagagagtgatcaataaatactgagggaactcagagaccagtgccgatgcgggtcctccgtatgctgagcgccggtcctctgggcccagtgttctttctctatactttgtctctgtgtcttatttcttttctcagtctcttatcccagctgatgagaaatagccacaggtgtggagggactggcccccctt

SEQ ID NO: 170 - DNA, 5663 bp, Homo sapiens
gtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatggctggtccttgccttaactgatgacattaccttgtgaaagtccttttcctggttcatcctggctcaaaaagcacctccactgagcaccttgcgacccccactcctacccgccagagaacaaaccccctttgactgtaattttcctttacctacccaaatcctataaaacggccctacccttatctcccttcgctgactctctttttggactcagcccgcctgcacccaggtgaaataaacagccatgttgctcacacaaagcctgtttggtggtctcttcacacggatgcacatgtaatttggtgaaatttggtgccgttactcggatcgggggacctcccttgggagatcaatcccctgtcctcctgctctttgctccatgagaaagatccacctacgacctcaggtcctcagaccgaccagcccaagaaacatctcaccaatttcaagtccggtaagctgcctctttttactctcttctccaacctccctcactatccctcaacctctttctcctttcaatcttggcgccacacttcaatctctcccttctcttaatttcaatttctttcattttttggtagagacaaaagagacatgttttatccatgaacccaaaaccccggtgccggtcacggactgggaaggcagccttcccttggtgtttaatcattgcagggatgcctctctgattatccactcacgtttcaagggtgtcagaccacgcagggacgcctgccttggtccttcacccttagcggcaagtcccgctttcctagggggcaaggaccccccaatcgcttatttccgcaccccaacctcttatctctgtgccccaatcccttatttccgcaccctgacctcttatctctgtgccccaatcccttatttccgtgtcccaaccccctctctgcttttctggagggcaagaaccccactcccctcctccgtgtctctacgctctcttttctcagggtttgcctccttcactatgggcaaccttccaccctccattcctccttcttctcctttagcctgtgtccttaagaacttaaaacctcttcaactcacacctgacctaaaacctaaatgccttattttcttctgcaacaccacttggccccaatacaaacttgacaatggccctaaatggccagaaaacggcacttttgatttctgcatcctacaagacctaaataatttttgtcgaaaaatgggcaaatggtctgaggtgccttacgtccaggcatttttcacacttcgttccctccctagcctctgttcccaatgcaattcctcccagatcctccttctttccctcccgcctgtcccctcagtcccaaccccaagcgtcgctgagtctttccagtcttccttttctacagacccatctgacctttcccctcctccccaggctgctcatcaccaggccgagctaagtcccaattcttcctcagcctccgctcctccaccctataatccttttatcacctcccctcctcacacccgatccggctcacagtttcgttccgtgactggccctcccccacctgcccagcaatttactcttaaaaaggtggatggagccaaaggcatagtcaaggttaatgctcctttttctttatcccaaatcagatagcatttaggctctttttcatcaaatataaaaatccagcccagttcatgactcgtttggcagcaaccctgagacactttacagccctagaccctaaaaagtcaaagggccgtcttattctcaatactcattttattacccaatccactcctgacattaaataaaactccaaaaattaaattccagccctcaaacctcacaacaggatttaattaacctcgccttcaaggtgtgcaataatagaaaacagttgcaattccttgcctccactgtgagacaaaccccagccacatctccagcacacaagaacttccaaacgcctgaaccacagcggccaggcgttcctccagaacctcctcccccaggagtttgctacaagtgccagaaatctggccactgggccaaggaatgcccgcagcccgggattcctcttaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagcccccagaccatcacggacgccgagctttgggtaactctcacagtggaaggtaagcccgtccccttcttaatcaatacggaggctactcactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaaattatctgcttccctgactattcctggactacagctatatctcattgccgcccttcttcccaatccaaagcctcctttgtgtcctcctcttgtaccccccaccttaacccacaagtataagatacctctactccctccttggtggccaatcatgcaccccttaccatctcattaaaacctaatcacccttaccccactcaatgccaatatcccatcccgcagcacgctttaaaaagattaaagactgttatcacttgcctgctacagcatggccttttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctgcctctataacccattattctgttctggatctcaaacatgctttctttactattcctttgcacccgtcatcccagcctctcttcactttcactttgactgaccctgacacccatcaagctcagcacattacctaggctgtactgctgcaaagcttcacagacagcccccattacttcaatcaagcccaaatttcttcctcatctgttacctatcttggcgtaattctcataaaaacacatgtgctctccctgccaatcgtgtccgactgatctctcaaaccccagcaccttctacaaaacaacaactcctttccttcctaggcatggttagcgtggtcagaattcttacacaagagccaggaccacaccctgtaggctttctgtccaaacaacttgaccttactgttttagcctagccctcatgtctgcgtgcagcggctgccactgctttaatacttttagaggccctcaaaatcacaaactatgctcaactcactctctacatttctcataacttccaaaatctattttcttcctcatacctgacacatatactttctgcttcccggctccttcagctgtactcactctttgttaactcccacaattaccgttgttcctggcccagacctcaatctggcctcccacattattcctgataccacacctgacccccacgactgtatctctctgatccacctgacattcaccccatttccccatatttccttctttcctgttcctcaccctgatcatgcttgatttattgatggcagttccaccaggcctaatcgccacacaccagcaaaggcagactacgctatagtacaagccactagcccacctcttagaacctctcatttcctttccatcatggaaatctatcctcaaggaaataacttctcagtgttccatctgctattctactactcctcagggattattcaggacccctcccttccctacacatcaagctcgaggatttgccccacccaggactggcaaattagctttactcaacatgcctgagtcagataactaaaatacctcttagtctggaggtattttagttactggataagtactggcctttcctacagggtctgagaaggccaccgcagtcatctcttcccttctgtcagacacaattcctcagtttagccttcccacctcaatacagtctgataacagatgagcctttattagtcaaatcagccaagcattttttcaggctcttagtattcagtgaaacctttatatcccttacggtcctccgtcttcaagaaaagtagaacagactaatggtcttttaaaaacacacctcaccaagctcagccaccaaaaaggactggacaatacttttatcactttcccttctcagaattcaggcctgtcctcggaatgctacaaggtacagcccatttaagctcctgtatagacgctcctttttattaggccccagtctcattccagacaccagaccaacttggactgtgccccagaaaacttgtcatccctactatcttctgtctagtcatactcctattcaccgttctcaactactcatacatgccctgctcttgtttacactgccggtttacactgtttctccaagccatcacagctgatatctcccggtggtatcccaaaactgccactcttaactcttgaagtaaataaataatctttgctggcaggactatgctgaatctccttaggcactctctaattagatgtcctaggtcctcccaattcttagtccttttatacctgtttttctccttctcttattccatttagtttttcaattcatacaaaaccgtatccaggccatcaccaatcattctatacgacaaacgtttcttctaacatccccacaatatcaccccttaccacaagatctcccttcagcttaatctctcccattctaggttcccacgccgcccctaatcccgcttgaagcagccctgagaaacatcgcccattctctctccataccaccccccaaaaattttcgccgccccaacacttcaacactattttatttttcttattaatataagaaggcaggaatgtcaggcctctgagcccaagccacgccatcgcatcccctgtgacttgcatgtatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtcctttccctggttcatcctggctcaaaaagcacccccactgagcaccttgcgacccccactcctgcccactgagcaccttgcgaccccgcactcctacccgccagataacaaaccccctttgactgtaattttcctttacctacccaaatcctataaaacggccccacccttatctcccttcgctgactctcttttcggactcagcccacctgcacccaggtgaaataaacagccatgttgcccacacaaagcctgtttggtggtctcttcacacggacgcgcatgaaa

SEQ ID NO: 171 - DNA, 463 bp, Homo sapiens
gtaggagattggtcagggtggtgggaacaattgtagaaagatgcaaaccttggaaggccaggggtttgcaaagcttctaaagaaaatttggctgaaggcagctgaattctcttaagagcttaggttaggtaacaaggggatgtaaagaaactgatctagataagtgagtttacttaggccccagaacctggcctttaatcgtctgcgagcaggactgctctgggtggtggggggagggtgaccatgttaattatccacaagtgtgttgactcaaagcctttgtcattaaatttgtgctgaataaatgcctgcggcaccagccagccgtggctgctgactctttacagtaccctccttggggtctgtaagcggcccggttccctaacccactctttcactagatatctgtgtctgagtgcatttgttcatccatcatttggccagggtctgcgggtctgaccca

SEQ ID NO: 172 - DNA, 770 bp, Homo sapiens
tcacagtaggtagctagtcagacacaagtagggcaggagagggcccccccacccgccatcaaactaagaacatcagtcgaccatcaggtgatggtcaggaagtagttaaatgtctcactaaaataataattggtcataggtggcacatgggaatggcagtctcccagtagacagaaaaaacctgaaactggtgatcagcagcttcctaataagatctcaggatttgggcaagtgggctcaagcatgtgcactaagaggcaaaatggtggagtttaactggtatatgaccttcctctaggaataatgaaccggtaagggaagaaagctcaggtgagcatgcatacaactcccataaacacagtgtacatgcagcccctcccaagtgccggcaggccactgcgcattcgaacagcccaccccaagggaagaatcagggagaagtaatgcaagacctggaagcatgccaatgtataaaaccccaagtcaaaggtcaaaacatgcacttgactctctcaagttgcccgcttgacccttttccaagtgtactctatttccttttgtttctgctctaaagctttttaataaactttcactggtgctctaaaagttgccacagtcactccctctgtcttatgctccttggtcaaattctttcttctgaggaggcaagaactgaggttgctgcagatccttacagatttgctacttctaacaaactttggtgctgcatgacttggatatattctctagtggtaatatactttgatgcc

SEQ ID NO: 173 - DNA, 2133 bp, Homo sapiens
tgggacaggaggactccttcaggagaccagttcccttgtcctcgccctcactccatgaggagatccacctatgacctcgggtcctcagaccaaccagcccaaggaacatctcaccaatttcaaatcaggtaaacagtcttttcagtctcttcgccaacctctcttgctatccctccacccttcaatctctctcttccttaatttcagttcctttccctttctggtagagacagagaagatgtgttttatccatgaactcaaaactccagtgccggtcacgaactcaggaagacagtcttcccttagtgtttaatcactgcggggatgcctgcctgattattcacccacattcagaggcatctgatcaccatggggatgcctgccttgatccttcaccttggtagcaagcaccacctcctctgggtggcaagtaccacccccaccctctgtgtctctaccctctcttttctctgggcttgcttctttcactatgggcaaccttccaccctccattcctccttcttctcccttagcctgtgtcctcaagaatttaaaacctcttcaattcttgcctgacctaaaccctaagggtcttattttcttctgcagcactgcttggccccaatacaaacttgataatggctctaaatggccagaaaatggcactctcgatttctccatcctacaagacctacataattttagtcgaaaaatgggcaaatggtctgaggtgcctgatgtccaggcattcatttacacatcagtccctccttagtctctgctcccaatgcaactcatcccaaatctttcttctttctctcctgtctgttcctttagtctccaccccaagctctgagtcctctgaatcctccttttctatggactcatttgacctctcccctcctccccaggctcctcctcaccaggccgagccaggtcccaattcttcctcagcctccactcccccaccctataatccttctatcacctcccctcctcataccaggtctggcttacagttttgttccacgactagccctcccccatctgcccaacaatttcctcttaaagaggtggctggagctaaaggcatagtcaaggttaatttttaaatgaacagtgttgtttttacctaaatcaatctggcctggtatatgacaacataaaaaaaaaaaactcaaggatagagcccaagagctcaccaaacaagcaaagaattatgctgaacccccttggacactctttaattggatatcctgggtcctcccaattcttagtcctttaatacctgtttttctccttcttttatttggaccttgtatcttccgtttagttcctcaattcatgcaaaactgcatccaggccatcaccaatcattctataccacaaaagctccttctaacaaccccacaatatcataccttaccccaaaatctttcttcagtttaatctctcccactgtaggttcccatgccgccccaatcctactcgaagcagccctgagaaacatcgcccattatccctccataccacccccaaaaattttcaccgccccaacacttcaccactattttgttttatttttcttattaatataagaaaacaggaatgtcaggcctctgagcccaagctaagccatcatatcccctgtgacctgcacatatacatccagatggcctgaagcaactgaagatccacaaaagaagtgaaaatagccagttcctgacttaactgatgacattccaccattgtgatttgttcctgccccaccctaactgatcaattaactttgtgacaatacaccctccccacccttgagaaggtactttgtaatatcctccccccacccactgcccttaagaaggtactttgtaatattctcccctgcccttaagaaggtactttgtaatattccccccacccttgagaatgtactttgtaagaaccaccccttgcccgcaaaaaattgctcctaactccaccgcctatctcaaacctataagaactaatgataatcccaccaccctttgctgactctctttttggactccacctgcctgcacccaggtgattaaaaagctttattgctcacacaaagcctgtttggtggtctcttcacatggacgcatgtga

SEQ ID NO: 174 - DNA, 658 bp, Homo sapiens
ttacagtaggtagtcaggcagacataagcaggacagagagggctcctcccgcccagccaagaatgtcaggtgatcatcaggtgatagtctaaaacaattgcttgcagccagtaccagggaaaggcagtctcccaatagatagaaaaaacttgaaactggtaatcagcagcttcccaataagatctcaggagtggggcaagtgggctcaagcatgcacattaagaggcaaaatggtggagtttaactggtatatggaacattaggctggtaagggaagaatgcttcaagtgggcatgtgtacaactctagaaagcccactgcacttgtgcttcctcccaagtgctagcagaacactgcacatgtggacagcccatcccaagggaagaatcacaggagaagggacgcacgaccctggaagtatgccattgtataaaactccaagtcaaagatcaaacagggcacttgatttctcaagttgcctgcttgggcctctttcaagtatactttacttccgttcattcatgccctaaaactttttaataagctctcaatcctgctctaaaaattgccttgttctctcactctgccttgtaacccctgggtcaaattctttcttctgaggaggcaaggaggttgccgtagatccttacagatttgc

SEQ ID NO: 175 - DNA, 739 bp, Homo sapiens
gtcaggcctctgagcccaagctaagccatcatatcccctgtgacctgcaggatatgctccagatggcctgaagcaactgaagatccacaaaagaagtgaaaatagccttaactgatgacattcctacactgtgatttgttcctgccccaccctaactgatcaatgtactttgtaatctcccccacccttaagaaggttctttgtaattctccccacccttgagaatgtactttgtgagatccaccccctgcccacaaaacattgctcctaaccccaccacctatcccaaaacctataagaactaatgataatcaggggggcacgatggctcaggcctgtaatcccagcactttgggaggccgaggcagccagatcacgagttcagaagatcgagaccatcctggctaacacagtgaaaccccgtctctagtaaaaatacaaaaatttagctgggcgtggtggcgggtgcctgtagtcccagctactcgggagggtgagacaggagaatggcgtgaacccgggaggcggagcttgcagtgagctgagactgcgccagtgcactccagcctgggtgacagagcgagactccatctccaaaaaagaaaaagaaccaatgataatcccaccaccctttgctgactctcctttcggactcagcccgtctgcacccaggtgaaataaacagccttgttactcacacaaagcctgtttggtggtgtcttcacccggacgcatgtga

SEQ ID NO: 176 - DNA, 3184 bp, Homo sapiens
gtcaggcctctgagcccaggccaggccatcgcatcccctgtgacttgcacgcatacatccagatggcctgaagtaactgaagatccacaaaagaagtaaaaacagccttaactgatgacattccaccattgtgatttgttcctgccccaccctagctgatcaatgtactttgtaatctcccccacccttaagaaggttctttgtaattctccccacccttgagaatgtactttgtgagatccacccctgcccagcagagaacaaccccctttgactgtaattttccattaccttcccaaatcctataaaacggccccacccctatctcccttccctgactctcttttcggacgcagcccgcctgcgcccaggtgaaatacacagccatgttgctcacacaaagcctgtttggtgggctcttcacacggacacgtatgcaatttggtgccgtgactcggatcgggggacctcccttgggagatcaatcccctgtcctcctgctctttgctccgtgggaaagatccacctatgacctcaggtcctcagaccgaccagcccaagaaacatctcaccaatttcaaatccggtaagcggcctctttttactctcttctccaacctccctcactatacccttagcggcaagtcccgctttcctggggcaggggcaggtacccctcaaccccttctccttcaccctcagcggcaagtcccgctttcctggggcaggggcaggtgcccctcgaccccttctccttcaccctcagcggcaagtcccgctttcctggggcaggggcaggtgcccctcaaccccttctccttcaccctcagcggcaagtcccgctttcctggggcaggggcaggtgcccctcgaccccttctccttcaccctcagcggcaagtcccgctttcctggggcaggggcaggtacccctcgaccctttctccttcaccctcagcggcaagtcccgctttcctggggcaggacttgccgctttcctggggtagggacaagtacccctgaaccccttctccacattacctgcttttcaagggcctgtttcccttgcctccataactgttgtgggtattgacagccaggcttctaaacctcttaaaactcccccactctggtgccaacttggacgacactcttttatgcactcttttttagttatccccacctgcccagttcccttattaggccgagatattttaaccaaattatctgcttccctgactattcctggactacagctgcaactcattgctgcccttctcgctaacccaaagcctccttcgcgtctttctttcatatccccccaccttaacccacaagtatgggacatctctactccttccctggcaactgatcacatgcccattaccatcccgttaaaacctaatcacccttaccccactcaacgccagtatcccatcccacagcatgctttaaaaggattaaagcctgttatcactcgcctgctacagcatgggcttctaaaacctataaactctccttaccattcccccattttacctgtcctaaaaccagacagggcttacaggttagttcagaatctgtgccttatcaaccaaattgttttgcctatccaccccgtggtgccaaacccatatactctcctatcctcaatacctgcctctacaacccattattctgttctggatctcaaacatgctttctttactattcctttgcacccttcatcccagcctctctttgctttcacttggactgaccctgacacccattaggctcagcaaattacctaggctgtactgccgcaaggcttcacagacagcccccattacttcaatcaagcccaaatttcttcctcatctgttacctatctcggcataattctcataaaaacacacgtgctctccctgccaatcgtgtccgactgatctctcaaaccccggcacctttctacaaaacaataactcctttccttcctaggcatggttagcgtggtcgtaattcttacacaagagccaggaccacaccctgtagcctttctgtccaaacaacttgaccttactgttttaacctagccctcatgtctgcgtgcagcggctgccgctgctttaatacttttagaggccctcaaaatcacaaactttatcagtcctccaggcccaagttgactcttcagctgcagttgtcctccaaaaccgccaaggccttgactgacttactgctgaaaaaggaggactctgcatattcttaaatgaggagtgttgtttttacctaaatgcatctggcctggtgtatgacaacataaaaaaactcaaggatagagcccaaaaacttgccaaccaagcaagtaattacgctgaacccccttgggcactctctaattggatgtcctgggtcctcccaattcttagtcctttaatacccatttttctcctccttttattcggaccttgtatcttccgtttagcttctcaattcatccaaaaccgtatccaggccatcaccaatcattctatacgacaaatgtttcttctaacatccccacaatatcaccccttaccacaagacctcccttcagcttaatctctcccactctaggttcccacgccgcccctaatcccgctcgaagcagccctgagaaacatcacccgttctctctccataccaccccccaaaaatttccgccgctccaacacttcaacgctattttgttttatttgtcttattaatataagaaggcaggaatgtcaggcctctgagcccaggccaggccatcacatcccgtgacttgcacgcatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccagcagagaacaaccccctttgactgtaattttccattaccttcccaaatcctataaaacggcccaacccctatctcccttccctgactctcttttcggacgcagcccgcctgcgcccaggtgaaataaacagccatgttgctcacacaaagcctgtttggtgggctcttcacacggacgcgcatgaaa

SEQ ID NO: 177 - DNA, 5747 bp, Homo sapiens
gtcaggcctctgagcccaagccaagccatcgcatcccctgtgacttgcatgtatacgcccagatgtcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccacccctgcccaccagagaacaacctcctttgactgtaattttccattaacttcccaaatcctataaaacggccccaccccatctcccttcgctgactctcttttcggactcagcccgcctgcacccaggtgaaataaacagccatgttgctcacacaaagcctgtttggtggtctcttcacagggacacggatgaaatttggtgccgtgactcggatcggggaacctcccttaggagatcaatcccctgtactccttttctttgccctgtgagaaagatccacctatgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccatggacccaaaactccggcgccggtcacggactgggaaggcagccttcccttggtgtttaatcattgcagggatgactctctgattatatacccacatttcaagggtgtcagaccacgcagggacacctgccttggtccttcactcttagcggcaagtcccgcttttctggggaaggggcaagtacctcaaccccttctctccttgtctctaccccttctctggtttcctggggcaggggcaagtaccccaaccccttctccttcacccttagccacaagttccgctttcctggggcaggggcaagtacccctcaaccccttctccttcacccttagcagccaagtcccgctttcctagggggcaagaacccccccaatcgcttatttccgcaccccaacctcttatctctgtgccccaatcccttatttccgcaccatgacctcttatctctgtgccccaatcccttatttccgtgccccaaccccttctctgcttttctggagggcaaggaccccctaccccttctccgtgtctctactcttgtctgggcttgcctccttcactatgggcaagcttccaccttccattcctcctccttctcccttagcctatattcttaagaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgtcataaaataggcaaacggtctgaggtgcctgacgtccaggcattcttttacacatcagtcccttcctagtctctgtgcccagtgcaactcgtcccaaatcttccttctctccctcccgcctgtcccctcagtaccaaccccaagcgtcactgagtctttctaatcttccttttctacagacccatctgacctctcccttcctccccaggctgctcctcgccaggccgagctaggtcccaattctttctcagcctctgctcctccaccctataatctttttatcacctcccctcctcacacctggtccggcttacagtttcgttccgtgactagccctcccccacctgcccagcaatttactcttaaaaagccaaaggcatagtcaaggttaatgctcctttttctttatcccaaatcagatagcgtttaggctttttcatcaaatataaaaatccagccccgttcaaggctcgtttggcagccaccctgagacgctttacagccctagaccctaaaaggtcaaaaggccgtcttattctcaatatacattttattacccaatctgctcccgacattaaataaaactccaaaaattggaatctggccctcaaaccccacaacaggacttaattaacttcaccttcaaggtgtacaataacagaaaaaagttgcaattccttgcctccactgtgagacaaaccccagccacatctccagcacacaagaacttccaaacgcctgaaccgcagcggccaggtgttcctccagaacctcctcccacaggagcttgctacacgtgccggaaatctggccactgggccaaggaatgcccgcagcccgggattcctcctaagccgcgtcccatctgtgtgggaccccactgaaaatcggactgttcaactctcctggcagccactgccagagcccctggaactctggcccaaggctctctgactgactccttcccagatcttctcggcttagcggctgaagactgacactgcccgatcgcctcggaagccccctagaccatcacggacgccgagcttcggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactgtggtgccaacttagacaacactcttttaagcactcctttttagttatccccacctgcccagttcctttattaggctgaaacactttaactaaattatctgcttccctgactattcctgaactacagctatatctcattgccgcccttcttcccaatccaaagcctcctttgcgtcctcctcttgtatccccccaccttaacccacaagtataagatacctctactccctccttggcgacggatcatgcaccccttaccatctcattaaaacctaatcacccttaccccactcaatgccaatatcccatcctgcagcacgctttaaaaagattaaagcctgttatcactcgcctgctacagcatggcctttcaaagcctataaactctccttacaatttctccattttacctgtcctaaaaccagacaagccttacaagttagttcaggatctgcgccttatcaaccaaattgttttgcctatccaccccatagtgccaaacccatatactctcctatcctcaatacctgcctctataacccattattctgttctagatctcaaacatgctttctttactatttctttgcacccttcatcccagcctctcttcactttcacttggactgaccctgacacccatcaagctcagcaaattacctaggctgtactgctgcaaagcttcacagacagcccccattacttcaatcaagcccaaatttcttcctcatctgttacctaattcagcataattctcataaaagcacacgtgctctccctgccaatcgtgtctgactgatctctcaaaccccagcaccttctacaaaacaacaactcctttccttcctaggcatggttagcatggtcagaattcttatacaagagccaggaccacaccctgtagcctttctgtccaaacaacttgaccttactgttttagcctagccctcatgtctgtgtgcagtggctgccgctgctttaacactgttagaggccctaaaaatcacaaactatgctcaactcactctctacatttctcataacttccaaaatctattttcttcctcatacctgacgcatatactttctgctctccggctccttcagctgtactcactctttaagtcccacaattaccattgttcctggcccggacttcaatctggcctcccacattattcctgataccacacctgaccctcatgactgtatctctctgatcctcctgatattcaccccatttccccatatttccttctttcctgttcctcaccctgatcacacttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgtcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagcattcagtgaaacttttatatcccttagggtcctccgtcttcaagaaaagtagaatggactaaaggtcttttaaaaacacacctcaccaagctcagccaccaacttaaaaaggactggacaatatttttaccactttcccttctcagaattcaggcctgtcctcggaatgctatagggtacagcccatttgagctcctgtatagacgctcctttttattaggccccagtctcattccagacaccagaccaacttagactgtgccccccaaaaaaacttgtcatccctactatcttctgtctagtcatactcctattcaccgttctcaactactcatacatgccctgctcttgtttacactgcctgtttacactgtttctccaagccatcacagctgatatctcctggtgctatccccaaactgccacacttaactcttgaagtaaataaataatcttggctggcaggactatgctgaatctccttaggcactctctaatcagatgtcttaggtctaaggaccttttatacctgtttttctccttctcttattccatttagtttttcaattcatacaaaaccgtatccaggccatcaccaatcattctatatgacaaatgtttcttctaacaaccccacaataccaccccttaccacaagacctcccttcagcttaatctctcccactctaggttcccacactgcccctaatcctgcttgaagcagccctgagaaacatcacccattctctctccataccacccccaaaaattttcgccaccctaatacttcaacactattttgttttatttttcttattaatataagaaggcaggaatgtcaggcctctgagcccaagccaagccatcgcatcccctgtgacttgcatgtttatgcccagatggcctgaagtaactgaagaatcacaaaagaagtgaaaaggccctgccccgccttaactgatgacattccactattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaacttcccaaatcctataaaacggccccacccctatctcccttcgctgactcttttcggactcatccggcctgcccccaggtgaaataaacagccatgttgctcacacaaagcctgtttggtggcctcttcacatggacgcacatgaaa

SEQ ID NO: 178 - DNA, 71 bp, Homo sapiens
tggctgactcttttcggactcagcccgcctgcgcacccaggtgaaataaacagccatgttgctcacaaaaa

SEQ ID NO: 179 - DNA, 708 bp, Homo sapiens
ttagagtaggtagttaggcagacatgagcagggcaggagagggccgcctctgccccaccaggaatgtcaggcaagtatcaggtgatggtcaggtggttgttcaactctctctctaaaataataattttttgcagccaatgacagggaaaggcagtctcccagtagaaagaaagtgcctgaagctggtgatcagcagcttcctgataagatctcatgatttgggcaagtgggctcaagcatgcacactaagaggcaaaatggcagagtttaactggtgtatgaccttcctctaggaacactcgactggtaaaggaaaaatgcctgaagtgagcatgtgtacaactttagtaaacatactgctcatgtggccccttccaactgctggcaggccagtgtgcatatggacagcccaccccaagggaagaatcagagtaagagagatgcaaccccctggatgcatgccaatatataaaaccccaagtcaaaagtcaaacgatgcacttgaatctcccaagttgccacttggccttcttcaaagtgtacattacttcctttcattcctgttctaaaactttttaattgtaactttcactcctgttctaaaacttgcctcagtctctcactgtgccctatgcccctcggtcaaattctttcttctgaggaggcaagaattgaggttgctgcagacctgtatggattcactgctgc

SEQ ID NO: 180 - DNA, 408 bp, Homo sapiens
gtcaggcctctgagcccaagctaagccatcacatcccctgtgacctgcaagtacacatccagatggcctgaagtaactgaagaatgacaaaagaagtgaaaatggcctgttcctgccttaactgatgacattaccttgtgaaattccttctcctggctcatcctggcttaaaagctcccccgctgagcaacttgtgacaccccctccccaccttgcccctgcccgccagagaaccccctttgactgtaattttcctttacctacccaaatcctataatatggccccacctcatctccctttgctgactctcttttcggactcagcccgcctgcacccagatgaaataaacagccttgttgctcatacaaagcctgttaggtggtctcttcacggggacaggagtgaaa

SEQ ID NO: 181 - DNA, 4422 bp, Homo sapiens
tacgacctcaggtcctcagaccgaccagcccaaaaaacatctcaccaatttcaaatccagtaagcggcctctttttactgtcttctccaacctccctcgctatccctcaacctctttctttcaatcttggcgccacacttcaatttctcccttctcttaatttcaattcctttcattttctggtagagacaaaggagacacgttttatccgtggacccaaaactctggcgccagtcacggactaaggaaggcagccttcccttcgtgtttaatcattgcagggacacacctctctgattattcacccaggtttcagaggtgtcagaccacgcagggacgacacctcccctccttgccaggccaagctagatcccaattcttcctcagcctctgctcctccaccctataatccttttatcatctcccctcctcacacccggtccggcttacagtttcgttccgtaactagccctccccctcctgaccagcaatttactcttaaaaagtcagctggagccaaaggcatagtcaaggttaatgctcctttttctttatcccaaatcagatagcgtttaggctctttttcatcaaatataaaaatccagcccagttcatggctcgtttggcatcaaccctaagacactttacagccctagactctaaaaggtcaaaaggccgtcttattctcagtatacattttattacccaaatctgctcccgacattaaataaaactccaaaaattaaattctggccctcaaaccccacaacaggacttaattaaccttgccttcaaggtgtacaataatagaggcggctaagtagcaacatatttcggagttgcaattccttgcctccactgtgagacaaaccccagccacatctccagctcacaagaacttccaaacgcctaaaccacagtggccaggtgttcctccagaaccacctcccccaggagcttgctacaagtgccagaaatctggccaccaggccaaggaatgcctgcagtccaggattcctcctaagccacgtcccatctgtgcaggaccccaatggaaatcagactgttcaactcacctggcagccactcccagagcccctggaactctggcccaaggctctctgactccttcccagatcttcttggcttctctgactccttcccagatcttctcggcttagcggctgaagactgatgccgcccgatcgccttggaagccccgtagaccatcacagatgctagctttaagtaactctcacagtggagggtaagtccgtccccttcttaatcaatatggaggctacccactccacattaccttcttctcaagggcctgtttcccttgcctccgtaactgttgtaggtattgacggccaggcttctaaacctttaaaactccccaactctggtacaatttagacaatactcttttaagcactccttttagttttccccacctgcccagttcccttattaggctgagacactttaactaaattatctgcttccctgactattcctggactacagccgcatctcattgacgcccttcttcccaatccaaagcctcctttgcatcctcctcttgtatcccccaccttaacccccaagtataggatacctctactccctccttggtgaccgatcattccccttaccatctcattaaaacctaatcacccttaccctgctcaacgccaatatcccaacctgcagcgtgctttaaaaagattaaagcctgttatcacttgcctgctacagcatggccttttaaagcctataaactctccttacaaatcccccattttacctgtcctagaaccagacaagccttacaggttagttcaggatcttcgccttatcaaccaaattgttttgcctatccaccctgtggtgccaaacccatatactctcctatcctcaatacctccctccacaacccattattctgttctggatctcaaacatgctttctttactattcctttgcgcgcttaatcccagcctctcttcgctttcacttagactaaccctgacacccatcaagctcagcaaattacctgggctgtactgccgcaaagcttcatagacaaccccccttacttcagtcaagctcaaatttcttcctcatctgttacctatctcagcataattctcataaaaacacacgtgctctccctgctgatcatgtccgaccaatctctcaacccccagcaccttctacaaaacaacaactcctttccttcctaggcatggttactgcggtcagaattcttacacaagagccaggaccacagcctgtagcctttctgtccaaacaacttgaccttaccgttttagcctacccctcatgtctgcgtgcagcagctgccactgctttaatacttttagaggccctaaaaatcacaaactatgctcaactcactctctacagttctcataacttccaaaatctattttcttcctcatacctgacgcatatactttctgcttcccagctccttcagctgtactcactctttgttaagtcccacaattaccattgttcctggcacagacttcaatccagcctcccacattattccagataccacacctgaccctcatgactgcatctctctgatccacctgacgttcaccccatttccccatatttccttctttcctgttcctcaccctgatcacacttagtttattgatggcagttccaccaggtctaatcgccacacaccagcaaaggcaggctatgctatagtacaagccactagcttgcctcttaaaacctctcatttcctttccatcgtggaaatctatcctcaaagaaataacttctcagtgttccatctgctattctactacttctcaaggattattcaggccccctcccttccctacacatcaagctcgaggatttgcccccacccaggactggcaaattagctttattcaacatgccctgagtcagataactaaaatacctcttagtctaagtagacactttcactggataggtagaggcctttcctacagggtctgagaaggccaccgcagtcatttcttcccttctgtcagacataattcctcagtttagccttcccacctctatacagtctgataacagaccagcctttactagtcaaatcacccaagcagtttttcaggcactcagtattcagtgaaacctttatatcccttacagtcctcagtcttcaagaaaagtagaacggactaatagtcttttaaaaacacacctcaccaagctcagccaccaacttaaaaaagactggacaatacttttacctctttctcttctcagaattcaggcctgtcctcagaatgctacaaggtacagcccacttgagctcctgtatggacgctcctttttattaggccccagtctcattccagacaccagaccaacttggactgtgccccaaaaaaacttgtcatccctactatcttctgtctagtcatactcctattcactgttctcaactactcatacatgccctgctcttgtttacactgccggtttacagtgtttctccaagtcatcacagctgatatctcctggtgctatccccaaactgccactcttaactcttaaagtaaataaataatctttgctggcaaggctatgctgaacctccttaggcactctctaattagatgtcctaggtcctcccaattcttagacctttaatacttgtttttctccttctcttattccgtttagtttttcaattcatacaaaaccatatccaggccatcaccaataattctaaatgacaaatgtttcttctaacaaccccacaatatcaccctttaccacaaaatcttccttcagcttaatctctcccactctacgttcccccgccgcccctaatcccgcttgaagcagccctgagaaacatcgcccattatctctccataccatcccccaaaattttcaccgtcccaacactttaccactatttcgttttatttttcttattaatataagaagacaggaatgtcaggcctctgagcccaagctaagccatcatataccatgtgacctgcacgtacacatccagatggctggttcctgccttaactgatgacattccaccacaaaagaagtgaaaacggcctgttcctgccttaactgatgacattgtcttgtgaaattccttctcctggctcatcctggcccaaaagctcccctactaagcaccttgtgacccccactcctgcccaccagagaacccccctttgactgtaattttcctttacctactcaaatcttataaaacggccccaaccctatctccctttgctgactctctttttggactcagcccgcctgcacccaggtgattaaaagctttattgctcacacaaagcctgtttggtggtctcttcacacggacactcatgaaa

SEQ ID NO: 182 - DNA, 4780 bp, Homo sapiens
gtcaggcctctgagccgaggccaggccatggcatcccctgtgacttgcacgtatacatccagatggcctgaagtaaatgaagatccacaaaagaagtaaaaacagccttaactgatgacattccaccattgtgatttgttcctgccccaccctaactgatcaatgtactttgtaatctcccccacccttaagaagttctttgtaattctccccactcttgagaatgtactttgtgagatgcaaccctgcccaccagagaacaaccccctttgactgtaattttccattaccttcccaaatcctataaaacggccccacccctatctcccttcgctgactctcttttcggactcagcccgcctgcacccaggtgaaataaacagccatgttgctcacacaaagcctgtttggtggtctcttcacacggacacgtatgaaacttggtgccgtgactcggatcgggggacctcccttgggagatcaatcccctgtcctcctgctctttgctccataagaaacatccacctacgacctcaggtcctcagaccgaccagcccaagaaacatctcaccaatttcaaatccggtaagcggcgtctttttaccctcttctccaacctccctcactatccctccacctctttctcctttcaatcttggccccacacttcaatctctcccttctcttaatttcaattcctttcattttctggtagagacaaaagagacatgttttatccgtgaacccaaaactctggcgccggtcacggactgggaaggcagccttcccttggtgtttaatcattgcagggacacctctctgattatacactcacctttcaaaggtgtcagaccacgcagggacgcctgccttggtccttcacccttagcggcaagtcctgctttcctggggcaggggcaagtacccctcaaccctttctccttcacccttagtggcaagtcccactttcctagggggcaagaaacccccaatccttatttccgcaccccaacctcttatctctgtgcctcaatcccttatttccgcaccctgacctcttatctctgtgcttcaatcccttatttccatgccccaaccccttctctgcttttctggagggtaagaaccccctaccccttctctgtgtctctactcttttttctgggcttgcctccttcactatgggtaagcttccaccttccattcctccttcttctcccttagcctgtgttctcaaaaacttaaaacctcttcaactcacacctgacctaaaacctaaatgccttattttcttctacaatgctgcttgaccccaatacaaactcaacagtggttccaaatagccggaaaacggcactttcaatttttccatcctacaagatctaaataattcttgtcataaaatgggcaaatggtctgaggtgcctgacttccaggcattcttttacacatcagtcccttcctagtctctgtgcccagtgcaactcgtcccaaatcttccttctttccctcccgcctgtcccctcagtcccaaccccaagtgtcgctgagtctttctaatcttccttttctacagacccatctgacctctcccctcctcgccaggccgagctaggttccaatacttcctcagcctctactcctccaccctataatccttctatcacctcccctcctcacacctggtctggcttacagtttcattctgtgactagccctcccccacctgcccagcaatttattcttaaaatggtggctggagctaaaggcatagtcaaggttaatgctccttttactttatcccaaatcagatagcgtttaggctctttttcatcaaatataaaaacccagcccagttcatggctcgttctgcagcaaccctgagacgctttacagccctagaccctaaaaggtcaaaaggccatcttatcctcaatatacattttattacccaatctgctcccgacattaaataaaactccaaaaattaaattctggccctcaaaccccacaacagcatttaattaaccttgccttcaagggtacaataatagaaaaaagttgcaattccttgcctccactgtgagacaaaccccagccacatctccagcacacaagaacttccaaacgcctgaaccgcagtggccaggcattcctccagaacctcctcccacaggagcttgctacacgtgccggaaatctgaccactgggccaaggaatgctcgcagcctgggattcctcctaagccatgtcccatctctgtgggaccccactgaaaatcggagtgttcaactcacctggcagccactcccagagcccctggaactctggcccaaggctctctgactgactccttcccagatcttcttggcttggcggctgaagactgacactgcccgatcgcctcggaagccccctagaccatcaccgacgccaagcttcggatagctctcacagtggaaggtaagcccatccccttcttaatcaatgcggaggctactcactccacattacctgcttttcaagggcctgtttcccttgcctccataactgttgtgggtattgacggccaggcttctaaacctcttaaaactccccaactctggtgccaacttagacaacactcttttaagcactcctttttagttatccccacctgcccagttcccttattaggctgagacactttaactaaattatctgcttccctgactatcctggactacagctatatttcattgccgcccttcttcccaatccaaagcctcctttgcgtcctcctcttgtatccccccaccttcacccacaagtataagatacctccactccctccttggcgaccgatcatgcaccccttaccatctcattaaaacctaatcacccttaccccactcaatgccaatatcccatcccgcagcacgctttaaaaagattaaagcctgttattacttgcctgctacagcatggccttttaaagcctataaactctccttacaattccctcattttacctgtcctaaaaccagacaagccttacaagttagttcaggatctgcgccttatcaaccaaattgttttgcctatccacccggtggtgccaaaaccatatactctcctatcctcaatacctgcctctataacccattattctgtcctagatctcaaacatgctttctttactattcccttgcacccttaatcccagcctctcttcgctttcacttggactgaccctgacacccaccaagctcagcaaattacctaggctgtactgctgcagagcttcacagacagcccccattacttcagtcaagcccaaatttcttcctcatctgttacctatctcggcataattctcataaaaacacacgtgctctccctgccaatcgtgtccgactgatctctcaaacccaagcaccttctacaaaacaacaactcctttccttcctaggcatggttagtgtggtcagaattcttacacaagagccaggaccacaccgtgtagcctttctgtccagacaacttgaccttactgttttagcctagccctcatgtctgtgtgcagcggctgccgctgctttaatactgttagaggccctaaaaatcacagactatgctcaactcactctctacagctctcataatttccaaaatctattttcttcctcacacctgacatatatactttctgctccccggctccttcagctatactcactctttgttgagtctcccacaattaccattgttcctggccgggacttcaatccggcctcccacattattccggataccacacctgaccctcatgactgcatctctctgatccacctgatattcaccccatttccccatatttccttctttcctgttcctcaccctgatcacgctagcctcgtgctatccccaaactgccattcttaactcttgaagtaaataaataatctttgctggcagggctatgctgaatctccttaggcactctctaatcagatgtcctgagtcgtcctaattcttagaccttttatacctgttttcctccttctcttattccatttagtttttcaattcatacaaaaccatatccaggccatcaccaataattctacacaacaaatgtttcttctaacaaccccacaatatcacctcttaccacaagacctcccttcagcttaatctctcccactttaggttcccacgccgcccctaatcccgcttgaagcagccctgagaaacatcgcccattctctctccataccaccccccaaaaacttccgccgctccaacacttcaacactattttgttttatttgtcttattaatataacaaggcaggaatgtcaggcctctgagcctaggccaggccatcgcatcccctgtgacttgcacgtatacatccagatggcctgaagtaactgaagatccacaaaagaagtaaaaacagccttaactgatgacattccaccattgtgatttgtttctgccccaccctaactgatcaatgtactttgtaatctcccccacccttaagaaggttctttgtaattctccccactcttgagaatgtactttgtgagatgcacccctgcccaccagagaacaaccccctttgaccgtaattttccattaccttcccaaatcctataaaatggccccacccctatctcccttcgctgactctcttttcggactcagcccgcctgcacccaggtgaaataaacagccatgttgctcacacaaagcctgtttggtggtctgttcacatggacgcgcatgaaa

SEQ ID NO: 183 - DNA, 2167 bp, Homo sapiens
cgcagtcagaattcttacacaagagccaggaccacaccctgtagcctttctgtccaaacaacttgaccttactgttttagcctagccatcatgtctgcgtgcagtggctgccgctgctttaatacttttagaggccctcaaaatcacaaactatgctcaactcactctctacagctctcataacttccaaattctattttcttcctcacacctgacgcatatactttctgcttcccggctccttcagctgtactcactctttaagtcccacaattaccattgtttctggcccagacttcaatccggcctcccacattattcctgataccacacctgacccccatgactgtatctctctgatccacctgacattcaccccatttccccacatttccttctttcctgttcctcaccctgatcactcttgatttattgatggcagttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctggaggatttgccccacccaggactggcaaattagttttactcaacatgccctgagtcagataactaaaatacctcttagtctaggtagatactttcactggataggtagaggcctttcctacagggtctgagaaggccaccgcagtcatttcttcccttctgtcagacataattcctacagtctgataacagatgagcctttattagtcaaatcagccaagcagtttttcaggctcttagtattcagtgaaacctttatatcccttacggtcctccatcttcaagaaaagtagaacggactaaaggtcttttaaaaacacacctcaccaagctcacccagcaacttaaaaaggactggacaatacttttaccactttcccttctcagaattcaggcctgtcctcggaatgctacagggtacagcccatttaagcttctgtatagacgctcgtttttattaggccccagtctcattccagacaccagaccaacttagactgtgcccccaaaaaacttgtcatccctactatcttctgtctagtcatactcctattcgttctcaactactcatacatgccctgctcttgtttacactgccggtttacactgtttttccaagccatcacagctgataatctcctggtgctatccccaaactgccactcttaactcttgaagtaaataaataatctttgcgggcaggactatgctgaatctccttaggcactctctaatcagatatcctgagtcgtcccaattcttagaccttttatacctgtttttctccttctgttattccatttagtttctcaattcatccaaaactgtatacaggccatcaccaatcattctatacgacaaatgtttcttctaacatccccacaatatcaccccttaccacaagacctcccttcagcttaatctctcccactctaggttcccacgccacccctaatcccgcttgaagcagccctgagaaacatcacccattctctctccataccaccccccaaaaattttcgccgccccaacacttcaacactattttgttttattttgcttattaacataagaaagcaggaatgtcaggcctctgagcccaagccaagccatcgcatcccctgtgacttgcatgtatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcccggctcatcctggctcaaaaagcacccccactgagcaccttgcgacccccactcctgcccaccagagaacaaacccccttgactgtaattttcctttacgtacccaaatcctataaaacgcccccccgacacttatctgccttttcggactcagcctgcctgcacccaggtgaaataaacagccatgttgctcacacaaagcctgtttggtggtctgttcacacagacgcgcatgaaa

SEQ ID NO: 184 - DNA, 5888 bp, Homo sapiens
gtcaggcctctgagcccaagccaagtcatcgcatcccctgtgacttgcacgtatacacccagatggcctgaagtaactgaagaatcaccaaagaagtgaatatgccctgccccaccttaactgatgacattccaccacaaaagaagtgaaaatggccagtccttgccttaagtgatgacattcccttgtgaaagtccttttcctggctcatcctggctcaaaaagctcccccactgagcaccttgcgacccccactccagcccgccagagaacaaaccccctttgactgtaattttcctttacctacccaaatcctataaaacggccccacccttatctcccttcgctgactatcttttcggactcagcctgcctgcaaccaggtgaaataaacagccatgttgctcacacaaagcctgtttggtggtctcttcacatggacgtgcatgaaatttggtgctgtgactcggatcgggggacctcccttgggagatcaatcccctgtcctcctgttctttgctccgtgagaaagatccacctacgacctcaggtcctccgaccgaccagcccaagaaacatctcaccaatttcaaatccggtaagtggcctcttcttactctcttctccaacctctctcactgtccctcaaccactttcttctttccattcttcaatctctcccttctcttaatttcaattcctttcattttcagggagagacaaaggagacacgttttatccgtggacccaaaactccggcgccggtcacggactgggaaggcagccttcccttggtgtttaatcattgcagggacgcctctctgattatacacccacgtttcaagggtgtcagaccacgcagggatgcctgccttggtccttcacccttagcggcaagtcccacttttctggggaaggggcaagtacctcaaccccttttctccttgtctctaccccttctctgcttttctgggagaggggcaagtacccctcaaccccttctctccttgtctctaccccttctctgctttcctggggcaggggcaagtacccctcaaccccttctccttcacccttagcggcaagtcctgctttcctggggcaggggcaagtacccctcaaacccttctctttcacccttagtggcaagtcccgcttttctagggggcaagaacccccaatcccttatttccgcaccccaacctcgtatctctgtgccccaataccttatttctgtgccccgacctcttatttccatgccccaaccccttatttctgtgccccatcccttatttccatgccctgacctcttatctctgcgccccaaccccttttcccacttttctggaaggtaagaacccccgaaccccttccctccgtttctctactctctcttttctctaggcttgcttccttcactataggcaactttccaccctccattcctctttctactcccttggcctgtgttctcaaaaacttaaaacctcttcaactcacacctgacctaaaacctaaatgccttattttcttctgcaatgccacttgaccccaatacaaactcaacagtagttccaaatagccagaaaacggcactttgaatttttccatcctacaagatctaaataattcttgtcgtaaaataggcaaacggtctgaggtgcctgacgtccaggcatcctttacacatcagtcccttcctagtctctgtgcccagtgcaacccgtcccaaatcttccttctttccctcctgcctgtcccctcagtaccaacaccaagcgtcgctgagtctttctaatcttccttttctacagacccatctgacctctcccctcctcgccaggccgagctaggtcccaattcttcctcagcctccgctcctccaccctataatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatgcagcccagttcatgatttgtttggcagcaaccctgagacgctttacagccctagaccctaaaaagccaaaaggccgtcttattctcaaaatacattgtattacccattctgctccgaaataaaactccaaaaattaaattccagccctcaaaccccacaacagtatttaattaacctcgcctttaaggtgtacaataatagaaaaaagttgcaattccttgcctccactgtgagacaaaccccagccacatctccagcacaagagaacttccaaacgcctgaaccgcagcagccaggcgttcctccagaacctcctcccccaggagcttgctacacatgccggaaatctggccactgggccaaggaatgcccgcagcctgggattcctcctaagccgcgtcccatctgtgtgggaccccactgaaaatcggactgttcaactcacctggcagccactcccagagcccctggaactctggcccaaggctctctgactccttcccagatcttctcggcttagcggctgaagactgacactgcccgattgcctcggaagccccctagaccatcaaggacgctgagcttcaggtaactctcacagtggaaggtaggcccgtccccttcttaatcaatacggaggctacccactccacattaccttcttttcaagggcttgtttcccttgcctccataactgttgtgggtattgacggccaggcttctaaacctcttaaaactccccaactctggtgccaacttagacaatactcttttaagcactccttttcagttatccccacctgcccagttcccttattaggctgagacactttaactaaattatctgcttccctgactatccctggactacagctatatctcattgccacccttcttcccaatccaaagcctcctttgcgtcctcctcttgtatccccccaccttaacccacaaatatgagatacctctactccctccttggcgaccgatcatgcaccccttaccatctcattaaaacctaatcaccattaccccactcagcgccaatatccaatcccgcagcacgcttgaaaaagattaaagcctgttatcactcgcctgctacagcatggccttttaaaacctataaactctccttacaatttccccattttacctgtcctaaaaccagaagagccttacaacttagttcagaatctgtgctttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcctcctcatctgttacctatcttggcataattctcataaaaacacacgtgctctccctgccaatcgtgtctgactgatcactcaaaccccagcaccttctacaaaacaacaactcctttccttcctaggcatggttagcgcggtcagaattcttacacaagagccaggaccgcaccctgtagcttttctgtccaaataacttgacattactgttttagcctagccctcatgtctgcgtgcagcggctgccgctgcattaatacttttagaggccctcaaaatcgcaaactgtgctcaactcactctctatagttctcataacttccaaaatctattttcttcctcatacctgacgcatatactttctgcttcctggctccttcagctatactcactctttgttgagtctcccacaattaccgttgttcctggcccggacttcaatctggcctcccacattattcctgataccacacctgacccccatgactgtatctctctgatccacctgacattcaccccatttccccaaatttccttctttcctgttcctcaccctgctcacacttgatttattgatggcagttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccgcccaggactggcaaattagctttactcaacatgccctgagtcagataactaaaatacctcttagtctaggtagatactttcactggataggtagaggcctttcctacagggtctgagaaggccaccgcagtcatttcttcccttctgtcggacataattcctcagtttaggcttcccacctctatacagtctgataacagacgagcctttattagtcaaatcagccaagcagtttttcaggctcttagtattcagtgaaacctttatatcccttacggtcctccgtcttcaagaaaagtagaatggactaaaggtcttttaaaaacacacctcaccaagccagccaccaacttaaaaaggaccggacaatacttttaccactttcccttctcagaattcaggcctgtcctcggaatgctacagggtacagcccatttgagctcctgtatagatgctctttttattaggccccagtctcattccagacaccagaccaacttagactgtgcccccaaaaaaacttggcatccctactatcttctgtctagtcatacatactcctattcaccgttctcaactactcatacatgccctgctcttgattacactgccagtttacactgtttttccaagccatcacagctgatatctcctgatgctatccccaaactgccacacttaactcttgaagtaaataaataatctttgctggcaggactatgctgaatctccttaggcactctctaatcagatatcctgagtcatcccaattcttagacgttttatacctgtttttctccttccgttattccatttagtttctcaattcatccaaaaccgtatccaggccatcaccaaatgtttcttctaacaaccccacaatatcaccccttaccacaagacctcccttcagcttaatctctcccactctaggttcccacaccgcccctaatcccgcttgaagcagccctgagaaacatcgcccattctctctccataccaccccccaaaaatttttgccgcgccaacacttcaacatcgttttgttttatttttcttattaatataagaaggcaggaatgtcaggcctctgagcccaagccaagccatcgcatcccctgtgacttgcacgtatacacccagatggcctgaagtaactgaagaatcacaaaagaagtgaatatgccctgccccaccttaactgatgacattccaccacaaaagaagtgaaaatggccagtccttgccttaagtgatgacattcccttgtgaaagtccttttcctggctcatcctggctcaaaaagcacccccactgagcaccttgtgacccccactcctgcccgccagagaacaaaccccctttgactgtaactttcctttacctacccaaatcctataaaacggccccacccttatctcccttcgctgactctcttttcggactcagcctgcctgcacccaggtgaaataaacagccatgttgctcacacaaagcctgtttggtggtctcttcacagggacgtgcatgaaa

SEQ ID NO: 185 - DNA, 5619 bp, Homo sapiens
gtcaggcctctgaacccaagccaagccatcgcatcccctgtgacttgcatgtatacatccagatggcctgaagtaactgaagatccacaaaagaagtgaaaaggccctgccctgccttaactgatgacattccaccattgtgatttgttcctgccccaccttaactgagggattaaccctgtgaatttccttctcctggctcagaagctcccccactgagcaccttgtgacccccgcccctgcccaccagagaacaaccccctttgactgtaattttccattaccttcctaaatcctataaaacggccccacccttatctccctttgctgactctcttttcggactcagcccacctgcacccaggtgaaataaacagccatgttgctcacacaaagcctgtttggtggtctcttcccacggatgcgcatgaaatttggtgccgtgactcggatcgggggacctcccttgggagataaatcccctgtcctcctgctctttgctccatgagaaagatccacctacgacctcaggtcctcagaccgaccagcccaagaaacatctcaccaatttcaaatccggtaagaggcctctttttactctcttctccagcttccctcactatccctcaacctgtttctcctctcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgcagggaagcctctctgattattcacccatgtttcaaaggtgtcagaccacgcagggacacctgccttggtccttcacccttagccgcaagtcccgcttctctccttgtctctaccccttctctgcttttctgggggaggggcaagtacccctcaaccccctctccttcacccttagtggcaagtcccgcttttctagggagcaagaacgcccaatcccttatttccacaccccaacctcttatctctgtgccccaattccttatttccatgccccaaccctttctctgcttttctggagggcaagaaacccctaccccttctccgtgtctctactcttttctctgggcttgcctccttcactataggcaagcttccaccttccattcctccttcttctcccatagcctgtgttctcaaaaacttaaaacctcttcaattctcacctgacctaaaatctaagcgtcttattttcttctgcaatgccgctcgaccccaatacaaactcaacagtagttccaaatagccggaaaatggcactttcaatttttccatcctacaagatctaaataattcttgtcataaaatgggcaaatggtctgaggtgcctgacgttcaggctttcttttacacatcagtcccttcctagtctctgtgcccagtgcaactcgtcccaaatcttccttctttccctcccgtctgtcccctcagtcccaaccccaagcgtcgctgagtctttttaatcttccttttctacagacccatctgacctctcccttcctcgccaggccaagctaggtcccaattcttcctcagcctccgctcctccaccctgtaatctttttatcgcctcccctcctcacacctggtctggcttacagtttcgttctgtgactagccctccctcacttgcccagcaatttactcttaaaaaggtggctggagccaaaggcatagtcaaggttaaggctcctttttctttatcccaaatcagaagcttttaggctcttttttttatcaaatataaaaacccagcccagttcatggcttattcggcagcaaccctgagacgctttacagccctagaccctaaaaggtcaaaaggccgtcttattctcaatatacattttattacccaatctgctcccgacattaaataaaactccaaaaattagaatctggccctcaaaccccgcaacaggacttaattaacctcaccttcaaggtgtacaataataaaaaaaaagttgcaattccttgcctccactgtaagacaaaccccagccacatctccagcacacaagaacttccaaacgcctgaactgcagcagccaggcattcctccagaacctcctcccccaggagcttcctacaagtgccagaaatctgaccaccaggccaaggaatgcctgcagcccaggattcctcctaagccatgtcccatctgtgcgggaccacactggaaatcggactgttcaactcacctggcagccactcccagagcccctggaactctggcccaaggctctctgactgattccttcttcgctttgcggctgaagactgatgctgcctgatcgcctcggaagccctgtagaccatcacggacgccgagctttaggtaattctcacagtggtgggtaagtccgtccccttcttaatcaatacggaggctacccactccacattaccttcttttcaaaggcctgtttcccttgcctccataactgttgtgggtattgacagccaggcttctaaacctcttaaaactccccaactctggtgccaacttagacaatactcttttatacactcttttttagttatccccacctgcccagttcccttattaggctgagatattttaaccaaattatctgcttccctgactattcctggactatagccgcatctcattgctgcccttcttcccaatccaaaagcctcctttgcttcctcctcctgtattcccccaccttaacccacaagtataagatacctctactccctccttggcgaccaatcacgcaccacttaccatctcattaaaacctaatcacccttacctggctcaacgccaatatcccatccaacagcaagctttaaaaggattaaaacctgttatcactcacctgctacagcatgggcttctaaaacctataaactctccttaccattcccccattttacctgtcctaaaaccagacaaggcttacaagttagttcaggatctgcgtcttatcaaccaaattgttttgcctatccaccccatggtgccaaacccatatactctcctatcctcaataactccctctactacccattattctgttctggatctcaaacatgctttctttactattcctttgcacccttcatcccagcctctctttgtcttcacttagactgaccctgacacccattaggctcagcaaattacctgggctgtactgccgcaaggcttcacagacagcccccattacttcagtcgagcccaagtttcatcctcatctgttacctatctcggcataattctcataaaaacacacgtgctctccctgctgatcgtgtccgattaatctcccaaacctcaatcccttacaaaagaacaactcctttccttcctaggcatggttagtgtggtcagaattcttacacaagagccaggagcacactgtgtagcctttctgtccaaacaacttgaccttactgttttagccaagccctcatgtctgcgtgcagcggctgctgctgctttaatactgttaggggccctaaaaatcacaaactatgctcaactcactctctacatttctcataacttccaaaatctattttcttcctcatacctgatgcatatactttcagctccccggctccttcagctgtactcactctttaagtcccacaattaccattgttcctggcccagacttcaatctggcctcccacattattcctgataccacacctgacccccatgactttatctctctgatccatctgatattcaccccatttccccatatttccttctttcctgttcctcaccctgatcacgcttgatttattgatggcagttccaccaggcctaatcgccacacaccagcaaaggcaggctatgctatagtacaagccactagcctgcctctcagaaactctcatttcctttccatcgtggaaatctatcctcaaggaaataacttctctgtgttccatctgctattctactactcctcagggattattcaggccccctcccttccctacacatcaagctcgaggatttgcccccacccaggactgccaaattagctttactcaacatgtcctgagtcagataactaaaatacttcttagtctaggtagactctttcactggataggtagaggcctttcctatagggtctgagaaggccaccacagtcatttcttccattctgtcagacataattcctcagtttagccttcccacctctatacagtctgataacagaccagcctttattagtcaaatcagccaagcagtttttcaggctcttagtattcagtgaaacctttatatcctttatggtcctccatcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagacgctcctttttattaggccccagtctcattcaacaccagaccaacttagactgtgccccaaaaaaacttgtcatccctactatcttttgtctagtcatactcctattcaccattctcaactactcatacatgccctgctcttgtttaccctgctggtttacactgtttctccaagccatcacagctgatatcttctggtgctatccccaaactgccactctaaactcttgaagtaaataaataatctttgctggcaggactatgctgaatttccttaggcacctctaatcagatgtcctaggtcctcccaattcttaagaccttttatacctgtttttctccttctcttattccatttagtttttcaattcaaacaaaaccgtatccaggccatcagcaatcattctatatgacaaatgtttcttctaacaaccccacaatatcaccccttaccacaagatctttcttcagcttaatctctcccactctaggttcccacgccgcccctaatcccgctcgaagcagccctgagaaacatcgcccattctctctccataccacccccaaaaattttcgccgcctcaagacttcaacactattttgttttatttttcttattaatataagaaggcaggaatgtcaggcctctgagcccaagccaagccatcgcatcccctgtgacttgcatgtatacatccagatggcctgaagtaactgaagatccacaaaagaagtgaaaaagccctgccccgccttaactgatgacattgcaccattgtgatttgttcctgccccaccttaactgagggattaaccctgtgaatttccttctcctggctcagaagctcccccactgagcacctttgtgtcccccacccctgcccaccagagaacaaccccctttgactgtaattttccattaccttcccaaatcctataaaatggccccacccctatctcccttcgctgactctctttttgcactcagcctgcctgcatccaggtgaaataaacagccatgttgctcacacaaagcctgtttggtggtcttttcacatggacgcgcacgaaa

SEQ ID NO: 186 - DNA, 639 bp, Homo sapiens
gtcaggcctgagcccaagctaagccatcatatcccctgtgacctgcatgtatacatccagatagcctgaagcaaccgaagatccacaaaagcagtgaaaatagcctgttcctgccttaactgatgacattccaccattgtgatttgttcctgccccaccctaactgatcaattgactttgtaacaatacaccctaccccccttgccataatgtactttgtgatattctctgcccccccattccccccccgcaccccccccacccccgcgaatgtactttgtacaatacaccctccccacccttgaggaggtactttgtaatatcctgccctgcctttaagaaggtactttgtaatattcttcccccaacccccccccctccggccgccccatccccccttaagaagatactttgtaatattccccccacccttgagaatgtactttgtgagatccacccctgcccgcaaaacattgctcctaactccacggcttatcccaaacctataagaactaatgataatcccaccaccctttgctgactctcttttcggacacagccccctgcaccctggtgactaaaaagctttattgctcacacaaagcctgtttggtggtctcttcacacagacgcacgtga

SEQ ID NO: 187 - DNA, 2178 bp, Homo sapiens
tgactctctttttggactcagctcgcctgcacccaggtgattaaaaagctttattgctcacacaaagcctgtttggtggtctcttcacatggacgtgagtgaaatttggtgccatgactcagatcgggggacctcccttgggagatcaatcccctgtcctcctgctctttgttctgtgagaaagatccacctacgacctctggtccccagaccaactagcccaaggaacatctcaccaattttaaatccagtaagtggcctctttttactctcttctacaacctctctcactatccctcaacctctttctcctttaaatcttggcgtcacacttcagtctctcccttctcttaatttcagttcctttccttttctggtagagatgaaggagacacgttttatccgtggacccaaaactccggcgccagtcaaggactggggaagacagtcttctcttggtgtttaatcacgcggagacgcctgcctgattattcacctaagtttcagaggtgtctgaccatgcagggacgcctgccttggtccgtcacccttagcagcaagtaccgcttttctggggggcaagaaccccccaaccccttctctccgtgtctctaccccttctccacttttctggcgggcaagaaccccccaaccccttctccttcacccttagcagcaagtaccacttttctagggggcaagaacccctcaaccccttctccttcactcttagtggcaagtactgcttttctagggggcaggaaccccccgaccccttctctctgtctttaccccttctctgcttttctgggggtcaagaaccccccaccccttctctccgtgtctctactctctcttttctctgggcttgcctccttcactatgggcaagcttccaccctccattcccccttcttctcccttagcctgtgttcttaaaaacctaaaacctcttcaacaaacacctgacctaaaacctaaatgccttatttccttctgcaatgccacttgacccaatacaaactcaacagtggttccaaatagcgagaaaatagcactttcaatttttccatcctatgagatctaaataattcttgccgtaaaataggcaaacggtctgaggtgcctgacgtccaggcattcttttacacgtcggtccctccctagtttctgttcccaatgcaacttgtcccaaatcttccttctttctctcccgcctgtccccttagtcccaaccccaagcatcgctgagtctttctaatattccttttctacagacccatctgacctctcccctcctcgccaggctgagctaggtcccaattcttcctcagcctctgctcctccaccctattatcctttttatcacctcccctcctcacaccaggtccggctcacagtttcgttctgagactagccctcccccacctgcccagcaatttcctcttaaaaaggtggctggagctaaaggcacaatcaaggttaatgctcctttttctttatcccaaattagagagcatttaggctctttttcaacagatataagaacccagcccagttcatggctcatttagcagcaaccctgagacgctttacagccctagaccctaaaaggtcaaaaggacgtcttattctcaatatacattttattatccaatctgctcccgacattaaataaaactccaaaaattaaattccagccctcaaaccccacaacaggacttaattaacctcgccttcaaggtgtacaataatagagtagaggcagccaagtagcaacatatttctgagttgcaattccttgcctccactgtgagacaaaccccagccacatctccacacacaaaaacttccaaatgcctaaaccacagtggccaggcattccttcaggcccgcctcccccagaagcttgctacaagtgccagaaatctggccaccaggccaaggaatgcccacagcccagaattcctcctaagctgcgtccaatctgtgcaggaccccactgaaaatcggacagttcaactcacctggcagccactcgcagagcccctggctctctgactgactccttcccagatcttctcggcttagtggctgaagactgacactgcccgatcaccttggaagccccctagaccatcacagacgccgagtttcaggtaactctcacagtgaaagg

SEQ ID NO: 188 - DNA, 5995 bp, Homo sapiens
gtcagggctctgagcacaagctaagccatcgtatcccatgtgacctggaagtatatatccagatggcctaaagtaactgaagaatcacaaaagaagtgaaaatagtctggtcctgccttaactgatgatattaccttgtgaaattccttctcctggctcatcctggctcaaaagctcccccactgagcaccttgtgacccccacccctgccagccataaaacaaccccctttgactgtaattttccactacctacctaaatcctataaaacggccccacccctatctcccttccctgactctcttttcggattcagcccgcctgcacccaggtgaaataaacagccttgttgctcacacaaagcctgtttggtggtctcttcatacagacgcgagtgaaatttggtgccgtgactcggattgggggaccacccttgggagatcaatcccctgtcctcctgctctttgctccatgagaaagatccacctatgacctcggatcctcagaccaaccagcccaaggaacatctcaccaattttaaatccggtaagtgacctctctttactctcttctctaacttctctcactatccctcaacctctttctcctttcaatcttggtgccacacttcaatctctcccttctgttaatttcagttcctttcctttcctggtagagacaaaggagatgcattttatccgtggacgcaaaactccagcaccggtcacagactcgggaagacagtcttcccttggtgtttaatcactgcagggacgcctgcctgattattcacccacatttcattggtatctgatcaccgcagggacgcctgccttggtcattcactcacattcccttggtggcaagtcaattgcagggacgcctgctttggctgctcacccacattgcagcccagggctgctcaccccacccattctctccatgcctctactctctcttttctctccactttcctggggggcaagcacctcccaccccttttccactttcctgggggacaagcacctcccaccccttctctctgtgtctctaccctctcttttctctgaactcgcctccttcactataggcaaccttccaccctccattcctccttcttctcccttagcctgtgttctcaagaacttaaaacctcttcgactcacacctgacctaaaacctaaatgccttattttcttctgcaacaccgcttgaccccaatacaaaatcgacaatggttccaaatagccggaaaacagcactttctatctctccatcctataagatctggataattcttggtgtaaaatgggcaaatggtctgaggtgcctgatgtccaggcattgttttacacattggtccctccctggtctctgttcccaatgcaacttgtcccaaatcttccttctttccctcccacctgtcccctcagtcccgaccccaagtgttgctgagtctttccaatcttccttttttatggacccatctgacctctcccctcctccccaggctgctcctcgccaggccaagccaggtcccaattcttcctcggcctccgctccccaaccctataatccttttatcacctcccctcctcacacccagtcccgcttatagttttgttctgccactagccctcccctacctgcccagcaatttcctcttaaaaaggtggctggagctgaaggcatagtcaaggtgaatgctcctttttctttatccggcctctcccaaatcagttagcgcttaggctctttttatcaaatataaatacccagcccagttcatggcttgtttggcagcaatcctgagacgctttacagccctagaccctaaaaggtcaaaagcccatcttatcctcaaaatacattttattacccaatctgctcccgacattaaataaaactccaaaaattaaattccagccctcaaaccccacaacatgacttaattaaccttgccttcagggtgtacaataatagagaagagttgcaattacttgcctctgctgtgagagaaaccccagccacatctccagcacacaaggacttcaaaacgcctaagccacagcggccaggcattccttcaggacttcctcccccaggatcttgcttcaagtgctggaaatctggccaccgggccaaggaatgcccgcagcccaggattcctcctaagccgtgtcccatctgtgtgggaccccagtggaaactggactgtccaactggcctaaggctctgactagctccttcccagatcttcttggcttagcggctgaagactgacgctgcccaatcaccttagaagcttcctggaccatcacagaagctctaggtaactcttacagtggagggtaagtctgtccccttcttaatcaatacagaggctacgtactccacattaccttcttttcaagggcccgtttcccttgcctccataactgttgtgggtattggcagccaggcttctaaaccccttaagactcccccactctggtgctaacttggacaacattcttttatgcattcttttttagttatccctacctgcccagttctcttattaggctgagacattttaactgaattatctgcttccctgactattcctggactacagccacatctcattgccacccttcttcccaacccaaagcctccttcatgccttcttctcatatccccccaccttaacccacaagtatgggacacctctactccctccctggcaactgatcaccagcccattatcccattaaaacctaatcaaccttaccctgctcaacactagtatcccatcccacaacaggctttaaagggactgaagcctgtgatgactcacctgctacagcatgggcttctaaaacctataaactctccttacaattcccccattttacctgtccaaaaaccagacaagccttacaggttagttcaggatccgcaccttatcaaccaaattgttttgcctatcccccccatggtgccaaacccatatactctcctatcctcaatacctccctccacaacccgttattctgttctggatctcaaacatgctttctttactattcctttgcacccttcatcccagtctttcttcgctttcacttggactgaccctgacacccatcaggctcagcaaattacctgggctgtactcccgcaaggcttcacagacagcccccattacttcagtcaagcccaaatttcttcctcatgtgttacctatctcgacatagttctcataaaaacacacgtgctctccctgctgatcgtgtccagctaatctcccaaaccctgaccccttctacaaaatgacaactcctttccttcctaggcatggttaggtacttccacctttggatacctcgtttttccatcctgactaaaccattatataaactcacaaaagcaaacctggctgaccccacagatcccaaatcctttcgccactcctttccattccttaaaaacagccctagaagctgctcccacactagctctccctaactcatcccaaccctttttcattaacacagctgaagtgcagggctgtgcagtcaaaattcttacacaaggactgggaccatgccctgtggcctctttatccaaacaacttgactttactgttttagcctagtcctcatgtctgtgtgcggtggctgccgctgccttaatacttttagaggtcctaaaaatcacaaactatgctcaactctctacagtcactctctacagttctcataacttccaaaatctattttcttcctcacacctgacacatatactttctgctcccctccactacctctcagcaagccaaactcatttccttaactcaagccctactcttgcaaaaggactacttgtcaatatttatactgactctaactatgccttccatatcctgccccaccatgctgttatatgggcagaaagaaatttcttcactacacaagggtcctccatcattaatgcctctttaataaaaactcttctcaaagccgctttacttccaaaggaagctggagtcattcactgcaagggccatcaaaaggcatcagatcccattgctcagggcaacgcttatgctgataaggtagctaaagaagcagctagcgttccaacttctctccctcatggcagtttttctccttctcatcggtcactcccacttactcccctactgaaacttccacctatcaatctcttcccacacaaggcaaatggttcttggaccaaggaacatatctccttccagcctcacaggcccattctattctgtcgtcatttcataacctcttccatgtaggttataagctgctagtctgcctcttagaacctctcatttcctttccatcgtggaaatctatcctcaaggaaatcacttctcagtgttccatctgctgttctactactcctcagggattgttcagggcccctcccttccctacacatcaagctcggggatttgcccttgcccaggactggcaaattgactttactcacatgccctgagtcaggaaactaaaatacgtctcggtctagatagacactttcactggatgggtagaggcctttcccacagggtctgagaaggccaccgcagtcatttcttcccttctgtcagacataattcctcagtttggccttcctacctctataccgtccaataacggaccggcctttattagtcaaatcacccaagcagtttctcaggctcttggtattcagtggaaccttcataccccttaccatcctcaatcttcaggaaaggtagaatggaacagactaatggtcttttaaaaacacacctccccgagctcagccaccaacttaaaaaggactagacaatacttttaccactttcccttctcaaaattcgggcgtgtccttggaatgctacagggtacagcccatttgagctcctatatagacactcctttttattaggccccagtcttattccagacagcagcccaacttggactgtgccccaaaaacttgttatctgtactatcttctgcctagtcatactcttattcactgttctcaactactcataaatgccctgctcttgtttacactgccggtttacactgtttctccaggccatcacagctgatatctcctggtgctatccccaaaccaccactcttaactccctcttaaagtaaatcaataatctttgctggcagggctatgctgaacctccttgggcactctctaattggatgtcctgtgtcctcccaattcgtagtcctttaataccagtttttctccttctcttattcggaccttgtgtcttccgcttagtttttcaattcatacaaaacaacatccaggccatcaccaattattctatatgacaaatgctccttctaacaaccctgcaatatcaccccttaccacgaaatcttccttcagctgaatctctcccactctgggttcccacgccacccctaatcccgcttgaagcagccctgagaaacatcgcccattatctctccatgccacccccccaaaattttcactgccccaacacttcaatactattttatgttatttttcttattaatataagaaggcaggaatgtcaggcctctgagcccaagctaagccatcgtatcccctgtgacctgcacatatacatccagatggcctgaagtaactgaagaatcacaaaagaagtgaaaatggcctgttcctgccttaactgatgacattaccttgtgaaattccttctcctggctcatcctggttcaaaagctccccaactcagcaccttgtgacctccacccctgccagccataaaacaaccccctttgactgtaattttccactacctacccaaatcctataaaatggccccacccctatctcccttccctgacactgttttcggactcagcccgcctgcacccaggtgaaataaacagccttgttgctcacacaaagcctgtttggtggtctcttcacagggacgtgcgtgaaa

SEQ ID NO: 189 - DNA, 6143 bp, Homo sapiens
gtcaggcctctgagcccaagctaagccatcatatcctctgtgacctgcatgtatacatccagatggcctgaagtaactgaagaatcacaaaagaagtgaaaatggcctgttcctgccttaactgatgacattaccttgtgaaattccttctcctggctcatcctggctcaaaagctcccctgctgagcaccttgtgacccccactcctgccagccagagaacaaccccctttgactgtaattttcctttacctacccaaatcctataaaacagccccacccctatctcccttcactgactctcttttcagactcagcccacctgcacccaggtaaaataaatggccttgttgctcacacaaagcctgtttggtggtctcttcacacggacacaagtgaaatttggtgccctgactcggatcgggggacctcccttgggagctcaatcccctgtcctcctgctgtttgctctgtgagaaagatccatctacaaccttgggtcctcagaccaaccagcccaaggaacatctcaccaattttaaatcgggtaagcggcctctttttactctcttctctaacctctctgactatccctcaacctctttctcctttcaatcttggcgccatctttcaatctctgccttctcttaatttcagttcctttccttttctggtagagacaggagacgcattttatccatgaacccaaaactccggcaccactcatggactcaggacgacagtcttcccttggtgtttaatcacgcggggatgcctgcctgattattcacccacgtttcagaggtgtctgaccacatggggatgcctgccttggtccttcacccttagcggcaagcaccacttttctggggggcaagcaccccccgaccccttctctccatgtctctaccctctcttttctgccttggtccttcacccttagtggcaagcaccacttttctggagggcaagcacccccctactccttctctccatgtctctaccccttttccactttcctggggggcaagcaccccccaccccttctttccatgtctctagcctctcttttctctgggcttgcctccttcactatggacaaccttccaccctccattcctccctcttctcccttagcctgtgttctcaaaaacttaaaacctcttcaactcacacctgatctaaaacctaaatgccttattttcttctgcaacactacttggccccaatacaaacttgacaatggctctaaatggccagaaaatggcactttcaatttttccatcctacaagatctagataattcttgtcataaaatgggcaaacggtctgaggtgcctgacgtccaggcattcttttacacattggtccctccctagtctctgttcccaatgcaactcatcacaaatcttccttctttccctccgcctgtcccctcagtcccaatcccaagtgttgctgagtctttccaatcttcctttttttttttttttttttacagacccatctgacctctcccctcctccccaggctgctccttgccaggccgcgccaggttccaattcttcctcagcctccgctcctccaccctataatccttttatcaactcccctcctcacacctggtcccgcttacagtttcattccatgactagccctccccaacctgcccagcaatttcctcttaaaaaggtggctggagctgaaggcatagtcaaggttaatgctcctttttctttacccgacctctcccaaatcagttagcgtttaggctctttttcatcaaatatgaaaaacccagcccagttcttggcccctttagcagcaacccttagactctttacagccctagactcggaagggtcagaagtccatctcattctaaatatgcattttatcacccagccagctcctgacattaaataaaactccaaaaattaaataaattccagccctcaaaccccacaacaggacttaattaacctcactttcaaggtgtacaataatacagtagaggcagccaagtagcaatgtatttctgagttgcaattccttacctccactgtgagacaaaccccagccacatctctagcacacaggagctccaaacgcctgaaccgcagcttccaggggttcctccagaacctcctcccccaggagcttgcttcaagtgccagaaatctggtcactgggccaaggaatgcccgcagcctgggattcctcctaagctgtgtcccatctgtacgggaccccactggatatcagactctccaacttgcccagcagccactcccagagcccctggaactctggcccaaggctctctgactgactccttcccagatctgcttggcttagcggctgaagactgacgcagccccgtcacctcggaagccccctggaccatcacggacgccgagctttgggtaactcttacagtggaaggtaagtccatccccttcttaatcaatacagaggctacacactccacattaccttttcaagggcctgtttcccttgtctccataactgttgtgggtattgacaaccaggcttctaaacctcttaaaactccccaactctggtgccaacttggataacattctttaatgcactgctttttagttaatcccacctgcccagctcccttattaggtctaggcattttaactaaattatctgcttccctgactattcctgggctacagccacacctcattgccaccttttcccccagttcaaagcttccttcacatcctccccttgtatctccccaccttaccccacaagtataggacacctctactccctccttggcgaccaatcatgcaccacttaccatcccattaaaacctaatcacccttaccccactcaatgccaatatcccatcccacagcccactttaaaaggattaaagcctgttatcactcgcctgctacagcatgggcttctgaaacctgtatactctccatacaattcccctattttacatgtccaaaaaccggacaagtcttacaagttagttcaggatctgcgccttatcaatcaaattgttttgcctatccaccccgtggtgccaaacccatgtactctcctatcctcaatacctccctccacaacccattattctgttatggatctcaaacatgctttctttactattcctttgcacccttcatcccagcctctctttgctttcacttggactgaccctgacacccattaggctcagcaaattacctgggctgtactgccacaaggcttcacagataggctcagtcaagcccaaatttcttcctcatctgttacatatcttggcataattctcataaaaacacacgtgctctccctgctgatcatgtccgactaatctcccaaaccccaatcccttctacaaaacaacaactcctttccttcctaggcatggttagtgcagtcagaattcttacacaagagccaggactgtgccctgtagcctttttatccaaacaacttgaccttactgttttagcctagtcctcatgtctgtgtgcagcagctgccactgccttaatacttttagaggacctcaaaatcacaaactatgctcaactcactctctaaaattctcataacttccaaaatctattttcttcctcccacatgatgcatatactttcttctccccagctccttcagctatacttactcattgttgaatctcccacagttccattgttcctggcccagacttcaatccggcctcccacattattcctgataccacacctgacccccatgactgtatctctctgatccacctgacattcactccatttccccatatttccttctttcctgttcactattggtttattgataaaccctgaacactattggtttattgatggcagctccaccaggcctaatcgccacttaccagcaaaggcaggctatgctgtagtatcttccatacctatcattgaggctacctctctgcccccctccactacctctcaaaaagccaaactcattgccttaactcaagccctcgctcttacaaaaggactatgcatcaatatttatactgactctaaatatgccttccatatcctgcaccaccatgctgttatatgggcagaaagaaatttcctcactatgcaagggtcctctatcattaatgcctctttaataaaaactcttctcaaagctgctttacttccaaaggaagctggagtcactcactgcaagggccatcaaaagtcatcagattccatcactcaggacaatgcttatgctgataaggtagctaaaaaagcagctagcgttccaacttctatccctcacggcagtttttctccttctcatctggccactcccacctactctcccactgaaacttccacctatcgatctcttcctacacaaggcaaatggttcttggaccaaggaaaatatctccttccagcctcacaggcccattctattctgtcatcatttcataacctcttccatggaggttacaagctgctagcccacctcttagaacctctcatttcctttcaatcatggaaatctaaccttaaggaaatcacttctcagtgttccatctgctattctactactcctcagggattgttcaggcccccccacttccctacacatcaagctcggggatttgtccccacccaggactggcaaattgactttactcacatgcctcagtcaggaaactaaaatacctcttggtctgggtagacactttcactgggtgggtagaggcttttcccacagggtctgagaaggccactgcagtcatttcttcccttctgtcagacataattcctcagttggccttcccacctctatacagtctgataacagaccagcctttattagtcaaatcactcaagcagtttctcaggctgttggtattcagtgaaacctttatatcccttaccatcctcagtcttcaggaaaggtagaacagactaatggtcttttaaaaacacacctcatcaagctcagccaccaacttaaaaagtaccggacaatacttttaccacttgcccttatcagaattcaggcctgtcctcagaatgctacagggtacagcccatttgagctcctgtatagacgctcctttttattaggccccagtctcattccagacaccagaccaacttagactgtgccccgaaaaacttgtcatccctactatcttctgtctggtcacactcctattcactgttctcaactactcatacaagccctgctcttgtttatgctgccggtttacactgtttctccaagccatcacatctgatatctcctggtgctatctccaaactgccactcttaactcgctcttaaagtaaataaataatctttgctggcagggctatgctgaacctccttgggcactctctaattggatgtcctgggtcctcccaattcttagtcctttaatacctgtttttctcctcttattctgtttagtttttcaattcatacaaaaccgtatccaggccatcaccaataattctatatgacaaatgtttcttctaacaaccccacaatatcaccccttaccacaaaatcttccttcagcttaatctctcccactgtaggtccccacgctgccccaatcccactcaaagcagccctgagaaacatcgcccattatctctccagatcaccccccaaaattttcaccaccccaacacttcaacactattttgttttatttttcttattaatataagaagacaggaatgtcaggcctctgagcccaggctaagccatcatatcctctgtgacctgcatgtatacatccagatggcctgaagtaactgaagaatcacaaaagaagtgaaaatggtctgctcctgccttaactgatgacattaccttgtgaaattccttctcctggctcatcctggctcaaaagctcccccgctgagcaccttgtgacccccccccacccctgccagccagagaacaaccccctttgactgtaatcttcctttacctacccaaatcctataaaacagccccgcccctatctcccttcgctctcttctgattcagcccacctgcacccaggtgaaataaacagccttgttgctcacacaaagcctgtttagtggtctcttcacacggac

SEQ ID NO: 190 - DNA, 961 bp, Homo sapiens
gtggggaaaagcaagagagatcagattgttactgtgtctgtgtagaaagaagtagacataggagactccattttgttctgtactaagaaaaattcttttgccttgagattctgttaatctatgaccttacccccaaccccgtgctctctgaaacgtgctgtgtcaaactcagggttaaatggattaagggctgtgcaggatgtgctttgttaaacaaatacttgaaggcagcatgctcgttaagagtcatcaccactccctaatctcaagtacccagagacacaacacactacagaaggccgcagggacctctgcctaggaaagccaggtattgtccaaggtttctccccatgtgatagtctgaaatatggcctcgtgggaagggaaagacctgaccgtcccccagcctgacacccgtaaagggtctgtgctgaggagaattagtataagaggaaggaatgcctcttgcagttgagacaagaggaaggcatctgtctcctgcctgtccctgggcaatggaatgtcttggtataaaaccggattgtacgttccatctactcagatagggaaaaaccgccttaaggctggaggtgggacatgcgggcagcagtactgctttgtaaagcattgagatgtttatgtgtatgcatatctaaaagcatagcacttgattctttaccttgtctatgatgcaaagacctttgttcacgtgtttgtctgctgaccctctccccactattgtcttgtgaccctgacacatccccctctcagagaaacacccaataatgatcaataaatactaagggaactcagaggctggcgggatcctccatatgctgaacgctggttccccgggtccccttatttctttctctatactttgtgtctttttcttttccaagtctctcgttccaccttacaagaaatacccacaggtgtggaggggcaacccaccccttca

SEQ ID NO: 191 - DNA, 430 bp, Homo sapiens
gtcaggcctctgagcccaagcctgcacatatacatccagagggcctgaggcaactgaagaaccataaaagaagtgaaaatggctggttcctgcctcaactgatgacattaccttgtgaaattccttttcctgtctcagaagctcccccactgagcaccttgtgactcccgcccctgcctacaggcgaacaaccccctttgactgtaattttccactacctacccaaatcctataaaactgccccccccaaaactccctttgctgactctcttttcagactcagcccacctgcacccaggcgattaaaaagctttattgctcacacaaagcctgtttagtggtctcctcacatggatgcgcatgacattaggtgccgtgacttggatcgggggacctcccttgggagatcaatcccctgtcctcctgttct

SEQ ID NO: 192 - DNA, 3275 bp, Homo sapiens
tacactagctctccgtgactcatcccaacccttttcattacacacagccaaagtgcagcgctgtgcagttgaaattcttacacaagaacaaggatctcatcctgtagcctttttgtccaaacaacttgaccttatcgttttaggttggctgttatgtctctgtgcagcagctgctgccaccctaatacttttaaaggcccttaaaatcacaaactatgctcaactcactctctacagctctcataatttccaaaatgtattttcctcctcacacctgccacatatacattctgctccccggctccttctgctgtactgtttgttgagtctcccacaattaccattgttcctggcccggacttcaatccggcctcccacattattcctgataccacacctgaccctcatgactgcatctctctgatccacctgacattcaccccatttccccacatttccttcttccctgtttctcaccctgaccacacttagtttattgatggcagttccaccaggcctaattgccacacaccagcaaaagcaggctatgctatagtacaagccactagcctgcctcttagaacctctcatttcctttccatcgtggaaatctatcctcaaggaaataacttctcagtgttccatctgctattctactaatcctcagggattcttcaggccccctcccttacctacacatcaagctcagggatttgcccccacccaggactggcaaattagctttaatcaacgtgccccgagtcaggaaactaaaataactctttgtctaggtagacactttcactggataggtagaggcatttcccacagggtctaagaagaccaccacggtcatttcttcccttctatcagacataattcctcagtttggccctcccacctctatagagtctgatagcagaccggcctttattaatcaagtcagccaagcattttttcaggctcttagtattcagtgaaacctttatatcccttacagtcctcagtcttcaggaaaggtagaacagactactggtctcttaaaaacacaccttaccaagatcagccaccaacttaaaaaggactggacaatacttttaccactttcccttctcagaattcaggcctgtcctcggaatgctgcaaggtacagcccatttgttgcgggaagtcagggaccccaaacggagggaccggctgaagccatggcagaagaacgtggattgtgaagattttatggacatttattagttccccaaattaatacttttgtaatttcttgtgcctgtctttactgcaatctctaaacataaattgtaaagatttcatggacacttatcacttccccaatcaatatccttgtgatttcctatgcctgtctttgctttaatctcttaatcctgtcagccaagaaggatgtatatggcctcaggaccctgtaataattgcgttaactacacaaattgtacagcatgtgtgtttgtgcaatatgaaatgtgggcaccctgaaaaaagaacaggataacagcaattgttcagggaataagagagatagccttaaactctgaccgccggtgagccgggcagaacagaaccatatttctcttctttcaaaagcaaatgggaaaaatatcgctgaattccttttctcagcatggaacgtccctgagaaagagaatgcgcacctaggggtagatctctgaactgccccccgcggggcgtacctgtctcttatggttgagattgcagaggtgaaataaactccagtctcccatagcactcccaggcttattaggaagaggaaattcccgcctaataaactttggtcagaccggttgatctcaaaactctgtctcctgataagatgttatcaatgacaatggtgccaaatttcattagcaattttaatttcactccggtcctgtggtcctgtgatctcaccctgtctccacttgccttgtgatattctattaccttgttaagtacttgatgtctgtcacgcacaccgattcgtatactccctccccttttgaaactccctaataaaaacttgctggtttttgtggcttgtcgggcatcacggatcctaccaatgtgtgatgtctcccccggacgcccagctttaaaagttctctcttttgtactctgtccttttatttctcaagccagtcgatgcttaggaaaatagaaaagaacctacgtgattatcggggcaggtctcccgatacccattggatctcccctatagatgctcctttttattaggccccagtctcattccagacacaagaccaacttggactgtgccccaaaaaacttgtcatccctactatcttctgtctagtcatacttctattcaccgttctcaactactcatatatgccctgctcttgtttacactggtggtttacactgtttctccaagccatcacagctgatatgtcctggtgctatccccaaaccaccactcttaactcttaaataatctttgctggcaagcctatgctgaacctccttaggcactctctaattagatgtcctaggtcctcccaattcttagtcctttaatacctgtttttctccttctcttattccgtttagtttttcaattcatacaaaactgtatccagggcatcaccaataattgtaaatgacaaatgtttcttctaacaaccccacaatatcaccccttaccacaaaatcttctttcagcttaatctctcctactctaggttcccatgccaccccaatcccgctcgaagcagccctgagaaacatcgcccattatctctccataccacccccaaaaaattttcaccatcccaatactttaccactatttcattttatttttcttattaatataagaagacaggaacgtcaggcctctgagcccaagctaagccatcatatcccctgtgacctgcatgtacacatccagatggccggttcctgccttaattgatgacattccaccacaaaataaatgaaaatggcctgttcctgccttaactgatgacattatcttgtgaaattccttctccttgctcatcctggctcaaaagctcccctactgcgcaccttgtgactcccactcctgccagataacccccctttttcctttacctacccaaatgctacaaaatggccccacccctatctcccttcgctgactctctttatggactcagcccacctgcacccaggtgaaataaacagctttattgctcacaaaaagcctgttttgtggtctcttcacacggacgcacatgaaa

SEQ ID NO: 193 - DNA, 5191 bp, Homo sapiens
gtcaggcctctgagcccaagccaagccatcgcatctcctgtgacttgcacctatacgcccagatggcctgaagtaactgaagaatcacaaaagaagtgaaaaggccctgccccgccttaactgatgacattccaccattgtgatttgttcctgccccaacttaactgaatgattaaccctgggaatttccttctcctggctcagaagctcccccactgagcaccttgtgacccccgcccctgcccaccagagaacaaccccctttgactgtaattttccattaccttcccaaatcctataaaacggccccacccctatctccctttgctgactctcttttcggactcagcccacctgcacccaggtgaaataaacaaccatgttgctcacacaaagcctgtttggtggtctcttcacacggacgcacatgaaatttggtgccgtgactcggatcgggggacctcccttgggagatcaatcctccgtcctcctgctctttgctccatgagaaagatccacctacgacctcaggtcctcagactgatcagcccaagaaacatctcaccaatctcaaatccggtaagtggcctctttttactctcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgcagggacacctctctgattatacactcacatttcaagggtgtcagaccacacagggacgcctgccttggtccttcacccttagtggcaagtcccgcttttctggggaagggtcaagtaccccaaccccttctcttgtctctaccccttctctgcttttctggggcaggggcaagtacccctcaaccccttctccttcacccttagcggcaagtcccgctttcctagggggcaagaaccccccaatcccttatttccacaccccaacctcttatctctgcgccccagtcccttatttccacgccccaacctcttgtctctgcgccccaatcccttatctctgcgccccaatcccttatttccacaccccaacctcttatctctgcgccccagtcccttatttccacgccccaacctcttatctctgcgtcccaatcccttatttccacgccccaacctcttatctctgcgccccaatcccttatctctgcgccccaatgccttatttccgcgccccgacccccccctcccgcttttctggaaggtaagaacccccgaaccccttccctccgtgtctctacgctctcttttctctgggcttgcctccttcactatgggcttgcctccttcactatgggcaagcttccaccttccattcctccttcttctcccttagcctgtattcttaagaacttaaaacctcttcaactctcacctgacctaaaatctaggcgtcttattttcttctgcaatgccgcttgaccccaatacaaactccacagtagttccaaatagccggaaaacggcactttcaatttttccatcctacaagatctaactaattcttgtcgtaaaatgggcaaatggtctgagatgcctgacgtccaggcattcttttacacatcagtccattcctagtctctgtgcccaatgcaactcgtcccaaatctcccgcctgtcccctcagtcccaaccccaagcgtcgctgagtctttctaatcttccttttctacagacccatctgacctctcccctcctcgcctggccaagctaggtcccaattcttcctcagcctccactcctccaccctataatccttttatcgcctcccctcctcacacctgctccggcttacagtttcattccgtgactagccctcccccacctgcccagcaatttactcttaaaaaggtggctggagctaaagacatagtcaaggttaatgctcctttttctttatcccagatcagatagcgtttaggctctttttcaccaaatataaaaacccagttcatggctcgtttggcagcaaccctgaggcgcttcacagccccagaccctaaaaggtcaaaaggccgtcttattctcaatatacattctattacccaatctgctcccgacattaactccaaaaattggaatctggccctcaaaccccacagcaggacttaattaacctcaccttcaaggtgtacaataacagaaaaaagttgcaattccttgcctccactgtgagacaaaccccagccacatctccagcacacaagaacttccaaacgcctgaactgcagcagccaggcgttcctccagaacctcctcccccaggagcttactacaagtgccagaaatctggccaccaggccaaggaatgcctgcagcccaggattcctcctaagccgtgtcccatctgtacgggaccccactggaaatcggactgttcaactcacctggcagacactcccagagcccctggaactctgacccagggctctctgactgactccttcttggcttaccggctgaaaactgacgctgcctgatcgcctcggaagccccgtagaccatcacggacgccgagctttaggtaactctcacagtggaaggtaagtccgtccccttcttaatcaatatggaggctacccactccacattaccttcttttcaagggcctgtttcccttgcctccataactgttgtgggtattgacagccaggtttctaaacttcttaaaactccccaactctggtgccaacttagacaacactcttttatgcactcttttttagttatctccacctgcccagttcccttattaggccgagatattttaaccaaatgatctgcttccctgactattcctggactacagccacatctcattgctgcccttcttcccaatccaaagcctcctttgcgtcctcctcttgtatcccccaccttaacccacaagtataagatacctctactccctccttggtgaccgatcatgcaccccttaccatctcattaaaacctaatcacccttaccccgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctatgccttatcaaccaaattgttttgcctatccaccctatgatgccaaacccatatactctcctatcctcaatacctccctccacaatccattattctgttctggatctcaaacgtgctttctttactactcctttgtacctgtcatcccagcctctcttcgctttcacttggactgaccctgacactcatcaggttcagcaaattacctgggctgtactgccgcaaggcttcacagacagcccccattacttcagtcaagcccaaatttcatcctcatctgttacctatctcggcataattctcgtaaaaacacacgagctctccctgctgatcgtgtctgattaatctcccaaacctcaatcccttacaaaacaacaaactcctttccttcctaggcatggttaatgcagtcagaattcttacacaagagccaggaccgcaccctgtagcctttctgtccaaacaacttgaccttactgttttagcctagccctcatgtctgcgtgcagcggctgccgctgctttaatacttttagaggcctttcctacaaggtctgagaaggccaccgtagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacctcaccaagctcagccaccaacttaaaaaggactggacaatacttttaccactttcccttctcagaagtcagacctgtcctcagaatgctacaaggtacagcccatttaagctcctgtatagacgctcctttttattaggccccagtctcattccagacaccagaccaacttcgactatgcccccaaataacttgtcatccctactatcttccgtctagtcatactcctattcaccattctcaactactcatacatgccctgctcttgtttacactgccggtttacactgtttctccaagccatcacagctgatatctcctcgtcctatccccaaactgccactcttaactcttgaataaataatctttgctggcaggactatgctgaacctccataggcactctctaattagatgtcctaggtcctcccaattcttagtccttttatacctgtttttctccttctcttattccacttagtttttcaattcatacaaaaccgtatccaggccatcaccaatcattctatacgacaaatgtttcttctaacaaccccacaatatcaccccttaccacagatctcccttcagcttaatctctcccactctaggttcccacaccgcccctaatcctgcttgaagcagccctgagaaacatcacccattctctctccataccaccccccaaaaattttcgccgccccaacacttcaacactattttgttttatttttcttattaatagaagaaggcaggaatgtcaggcctctgagcccaagccaagccatcgcatcccctgtgatttgcacctatacgcccagatggcctgaagtaactgaagaatcacaaaagaagtgaaaaggccctgccccgccttaactgacgacattccaccattgtgatttgttcctgccccaacttaactgagtgattaaccctgggaatttccttctcctggctcagaagctcccccactgagcaccttgtgacccccgcccctgcccaccagagaacaaccccctttgactgtaattttccattaccttcccaaatcctataaaacggccccacccctatctcccttcgctgactctcttttcggactcagcccacctgcacccaggtgaaataaacaaccatgttgctcacacaaagcctgtttggtgttctcttcacacggacgcgcatgaaa

SEQ ID NO: 194 - DNA, 5610 bp, Homo sapiens
gtcaggcctctgagcctaagctaagccatcatatcccctgtgacttgcacatacacatccagatagctggttcctgccttaactgatgacattccaccacaaaagaaatgaaaatggcttgttcctgccttaactgatgacattgtcttgtgaaattccttctcctggctcatcctggctcaaaagctcccctgctgagcaccttgtgacccccccactcctgcccaccagagaacaacccccctttttcctttacctacccaactcctataaaacggccccactcctatctcccttcgctgactctcttttcggactcagcccgcctgcacccaggtgaaataaacagctttattgctcacacaaagcctgtttggtggtctcttcacatggacacgagtgaaatttggtgttggtgccgtgactcggagtgggggacctcccttgggagatcaatcccctgtcctcctgctctttgctccgtgaaaaagatccacctatgacctcgggtcctcagacccaccagcccaaggaacatctcaccaatttcaaatccggtaagcagcctctttttactctcttctccaacctccctcactatctctcaacctctttctcctttcaatcttggcaccacacttcaatctctcccttctcttaatttcaattcctttcactttctggtagagacaaaggagacacattttatccacggacccaaaactccggtgccggtcatggactcgggaaggcagccttcccttggtgtttaatcattgcaaggatgcctctctgattattcacccacattccattggtgtctgatctccgcagggacacctgccttggtcattcacccacgttcccttggtggcaagtcaattgcggggatgcctgctttggctgctccccatcccctactccacgtctctacccttctctttaaacttgcctccttcactataggcaacattccaccctccattcctccttcttctcccttagtctgtgttcttaagaacttaaaacctcttcaactctcgcctgacctaaaatctaagcgtcttattttcttctgcaatgctgcttgaccccaatacaaattcgacggtagttccaaatagccagaaaatggcactttcaatttttccatcctacaagatctaaataattcttgtcataaaataggcaaacggtctgaggtgcctgacgtccagccattcttttacacatcaatccctccttagtctctgttcccaatgcaactagtcccaaatcttccttctttccctcctgcctgtcccctcagtcccaaccccaggtgtcactgagtctttctaatagtccttttctacagactcatctgacttctcccctcctcgccaggctaagtcccaattcttcctcagcctctgctcctccaccctataatccttttatcacctcccctcctcacacctggtctggcttccagtttcattctgtgactagccttcccccacctgcccagcaatttcctcttaaaaaggtggctagagctaaaggcatagtcaaggttaatgctcctttttctttatcccaaatcagatagcgtttaggctctttttcatcaaatataaaaacccagcccagttcatggctcgtttggcagcaaccctgagatgctttacagccctagaccctgaaaggtcaaaaggccgtcttattctcaatatacattttattacccaatctcctcccgacattaaataaaactccaaaaattaaattccggccctcaaactccacaacaggacttaattaacctcgccttcaaggtgtacaataatagagtagaggcagccaagtagcaacatatttctgagttgcaattccttgcctccactatgagacaaaccccagccacatctccagcacacaagaacttctaaacgcctaaacctcagtggccaggcattcctccaggcctgcctcccccaggagcttgctacaagctctggaaatctggccactgggccaaggaatgcccacagcccaagattcctcctaagctgtgtcccatctgtgcaggaccccactgaaaatcggactgttcaactcacctggcagccacttccagagcccctggaactctggcccaaggctctctgactccttcccagatcttctcagcttagcagctgaagactgatactgccggattgcctcagaagcctacaagaccatcacagacgctctaggtaactctcacagtggaaggtaagtccatccccttcttaatcaatacggaggctacccactccacattaccttcttttcaaaggcctgtttcccttgcctccataactgttgtattgacagccaggtttctaaacctcttaaaactccccagctctggtgccaacttagacaatactcttttaagcaatccttttagttatccccacctgcccagttcccttattaggccgagatattttaactaaattatctgcttccctgactattcctgggctacagacacacctcattgccaccttttcccccagttcaaagcctccttcacatcctccccttatatctccccaccttaacccacaagtataagatacctctactccctccttagcgacctataatccaccccttaccatctcattaaaacctaatcacccttaccccgctcagtaccaatatcccatcccacagcacgctttaaaaggattaaagcctgttatcactcacctgttacagcatggccttttaaagcctataaactctccttacaattcctccattttacctgtcctagaaccagacaagccttacaggttagttcaggatctgcaccttatcaaccaaattattttgcctatccaccctatggtgccaaacccatatactctcctatcctcaatacctccctccacaacccattattctgttctagatctcaaacatgctttctttactattcctttgcacccttcatcccagcctctcttcgctttcacttggactgaccctgacacccatcaggctcagcaaattacctgggctgtactgctgcaagcttcacagacagcccccattacttcagtcaagcccaaatttcttcctcagctgttacctatctcagcgtaattctcataaaaacacacgtgctctccctgctgatcctgttcagctgatatctcaaaccccaacagctataaaacgacaactcctttccttcctgggcatggttagacactttcgactttagatacctggttttgctatcctaacaaaaccattatataaactcacaaaaagaaacctagctgaccccatagatcctaaatcctttccccattcctctttccgttccttgaagacagctttagagactgcccccaccctagctctccctgacaaatcccaacccttttcattacccacagccaaagtgcaggcctgtgcagttagaattcttacacaagaaccaggactacaccctgtagcctttttatccaaacaacttgaccttactgttttgcctagccctcaagtctgcgtgcagtggccaccactgccctaatacttttagaggcccttaaaatcacaaactatgctcaactcactctcaacagttctcataacttcctcacacctgacgcatatactttctgctccccagctattttcttcctcacacctgacgcatatactttctgctccccagctccttcagctgtactcactctttgttgagtctcccacaattaccattgttcctggtccggacttcaatccggcctcccacattattcctgataccacacctgacccctatgactgtatctctctgatgcacctgacattccaccccatttccccatatttccttctttcctattcctcaccctgatcacacttagtttattgatggcagttccaccaggcctaatcaccacaccagcaaaggcaggctatgctatagtataagccactagcccgcctcttagaacctctcatttcctttccatcgtagaaatctatcctcaaggaaataacttctcagtgttccatctgctattctactacccctcagggattattcaggccccctcccttccctacacatcaagctcaaggatttgcccccacccaggactgggaaagtagctttactcaacatgccctgagtcaggaaactaaaatacctcttagtctaggtagacactttcactggataggtagaggcctttcccacagggtctgaaaaggtcaccgcagtcatttcttcccctctgtcacacataattcctcgctttggccttcccacctctatacagtccaatagcagaccggcttttcaggctcttggtattcagtgaaacctttataccccttacggtcctcagtcttcagaaaaggtagaacagactaatagtcttttaaaaacacacctcaccaagctcagccaccaacttaaaaagaactggacagtacttttaccactttcccttctcagaattcaggcctgtcctcggaatcctacaaggtacagcacatttaagctcctgtatggacgctcctttttattaggccccagtcttattccagacaccagaccaacttaagactgtgccccaaaaaaacttgtcatccctactatcttctgtctagtcatactcctgttcactgttctcaactactcatacgtgccctgctcttgtttacactgccagtttacactgtttctccaagctatcacagctgatatctcctggtgctatccccaaactgccactcttaactcttaaataaataatctttgctggcagaactatgctaaatctccttaagcactctctaattacatgtcctaggtcctccccattcttagaactttaatacctggttttctccttctcttattccatttagtttttcaattcatataaaaccgtatccaggccatcaccaataattctacatgacaaatgtttcttccaataaccccacaatatcaccccttaccacaaaatcttccttcagcttaatctctcccactccaggttcccacgcctcccctaatcctgagaaacatcacccattctctctctccataccaccccctgccaaaaatgtttcgccgccccaacacttcgacactattttgttttattcttcttattaatataagaagacaggaacgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttctcctggctcatcctggctcaaaaagctcccccactgagcaccttgtgacccccactcctgcccaccagagaacaacccccctttttcctttacctacccaaatcctataaaacggccccacccctatctcccttcgctgactctctttttggactcagcccgcccgcctgcacccaggtgaaataaacagctttattgctcacacaacgcctgtttggtggtctcttcacacggacgcgagtgaaa

SEQ ID NO: 195 - DNA, 969 bp, Homo sapiens
gtgggggaaagaaaaagagatcagactgttactgagtctacgtagaaaaaggaaggcataagaaactacattttgatctgtactaagagaaattcttctgccttgagatgctgttaatctgtgaccctagccccaactctgtgctcgcagaaacaggtgctgtattgactcaggtttaatggatttagggctgtgcaggatgtgccttggtaaacatgtgtttgtaggcagtatgcttggtaaaagtcatcgccattctcctttcttgactacccagggacacagtgtactgtggaaggtcgcagggacctgtgcccaagaaagcctgggtattgtccaagttttcccccaactgagacagcctgagatatggccttgtgggaagggaaagatcttaccatcccacagcccgacacccataaagggtctgtgctgagaaggattagtgaaagaggaaggcctctttgcagttgagataagaggaaggcatctgtctcctgctcatccctgggaatggaatgtcttggtgtaaaacccgatcatacattctatttactgagataggagaaaactgccttgtggctggaggtgagacatgctggcagcaatactgctctttactgcactgaaatgtttgtgtaaagtcaaacataaatctggcctatgtgcacatccaggcacagcaccgttccttaaacttatttatgacacagactcctttgctcacatgttgtcctgctgaccctctccccaccattaccctacagtcctgccacatcccctcatcaagatagtagagatagtgatcaataaatactgaggaactcagagaccagtgctggtgcaggtcctcacttgctgagcgccagtccccacttttcttcctctgtactttgtctctgtgtcttatttcttttttcggtccctcgtctccaccttgcgagaaatacccacaggtgtggaggggca

SEQ ID NO: 196 - DNA, 353 bp, Homo sapiens
ccacaaaagaagtgaaaatagtcagttcctgccttaactgatgacacaccaccactgtgatttgttcctgccccactctaactgatcaatggaccttgtgacattccttctcctggacaatgaatctcaggagctccccagtgagcaccttgtgacccccacccctgcccgcaagagaaaaacccccattaactgtaattttccactacctacccaaatcctataaaactgccccacccctacctccctttgctgactcctttttcactcagtccacctgcacccaggagattaaaaagctttattgctcacacaaagcctgtttggtggtctcttcacatggacacacgtaa

SEQ ID NO: 197 - DNA, 412 bp, Homo sapiens
gtcaggcctctgagcccaagctaagccatcatatcccctgtgacctgcacgtacacatccacatggccggttcctgccttaactgatgacatttcaccacaaaagaagtgaaaatggcctgttcctgccttaactgatgacattgtcttgtgaaattccttctcctggctcatcctggctcaaaagctcccctactgagcaccttgtgacctccagtctgcccgccagagaacaacccccctttgactgtaattttcctttatccacccaaatcctataaaatggccccacccctatctcccttcaatgactctcttttcggactcagcccacctgcatccagatgaaataaacagctttattgctcacacaaaacctgtttggtggtctcttcacacggacaagcatgaaa

SEQ ID NO: 198 - DNA, 7910 bp, Homo sapiens
tggctggttgctgccttaactgatgacattccaccacaaaagaaatgaaaatggcctgttcctgccttaactgatgacattatcttgtgaaattccttctcctggctcaaaagctcctctactgagcaccttgtgacccccactcctgcctaccagagaacaaaccccctttgactgtaattttcctttacctacccaaatcttataaaatggccccacccctgtctcccttcgctgactctttttggactcagcccgtctgcacccaggtgaaataaacagccttgttgctcacacaaagcctgtttggtggtctcttcacaccaatgcaagtgaaattttggtgccctgactcggactggggtatctcccttgggagatcaatcccctgtcctacagaatgggagaagaattttgcaatctactcaacttacaaagggctaatatccagaatctacgaagaactcaaaaaatttaccagaaaaaaacaaacaaccacatcaaaaagcaggcaatggatatgaaaagacacttctcaaaagaagacatttatgcagccaacagacacatgaaaaaatgctcatcatcactggccatcagagaaatgcaaatcaaaaccacaatgaggtaccatctcacaccagttagaatggtgatcattaaaaagtcaggaaacaacaggtgctggagaggatgtggagaaataggaacacttttacactgttggtgggactgtaatctagttcaaccattgtggaagtcagtgtggcgattcctcagggatctagaactagaaataccatttgacccagccatcccattactgggtatctacccaaaggattataaatcatgctgatacaaagacacatgcacacgtatgtttactgtggcactattcacaatagcaaagacttggaaccaacccaaatgtccaaaaatgatagactggattaaaaaaatgtggcacatatacaccatgcaacactatgcagccataaaaaagggtgagttcatgtcctttgtaggtaaatggctgaagctggaaaccatcattctcagcaaaatatcgcaaggacaaaaaacgaaacaccacatgttctgacttataggtgggaatagaacaataagaacacttggagactgaaaggggaacaccacacaccggggcctgctgtgggaagggggagaggggagggatagccttaggagatatacctaagataaatgactagttaatgggtgcagcacaacagcatgtcacatgtacacatatgtaacaaaccttcacgttgtgcacatgtgctctagaacttaaagtattttatatgtatatatgtataaacatatatacatatatacatataaacacatataaacatatacgtatatacacatatatacaaatacatatatacatatattatatatatgtatatatattatattatacatatattatatatatattatattatacatatatacatacacacataaacatattacatacatatacaaattatacacatatacatatatacatatatgtatatacatacattatatataaatatatgtatataaaatgtacattatatatacatatatattatgtataaataatatataaaataaacataatatatatttatagatatgatatatataatatatatgtatacatatatacatatatgtatatataatgtacattatacatacataaacatcatatataaatgttatatatataatataaatatatataatatataatatatactttatatactatatataatatatataatatgatataacatatactatatatactatatataatatatactatatatactgtatataatatataatataatatatactatatatactaaatataatatacataatataatatatactatatataatatataatatataatatagtatatatactatatataataattacatattatatattatacattatatattatataattattatatataattatatattacatactttgtatataatgtaaatatacattagaatatataatgtatatatatgtacatatataatgtatatatgtatacattatataaactatatataaacattatattatataaacattatatataaacattgtatgtacatatcatatatattatatgtgtgtatatatatatattatatgtgtgtatatatataaaaaatccccctacgacctctcgtcctccatccaaccagcccaaggaacatctcaccaattttaaatctggtaagcagcctctttttactctcttctccaacctctctcactatccctcaacctctttctcctttcaatcttggtgctatacttcaatctctcccttctcctaatttaagttcctttccttttctgttagagacaaaggagatgcattttatccatggacccaaaactccggcaccagtcacggactcgggaagacagtcttcccttggtgtttaatcacacggggatgcctgcctgattattcacccacgtttcagaggtgtctgaccatgcggggacgcctgccttggtccttcacccttagcggcaagtaccgcttttctggggggcaagacgtcctccaaccccttctgtgtctctaccccttctctgcttttctgggggacaagaacctcctaaccccttctccttcatccttagtggcaagtaccacttttctgggggtcaagaaccccccaccgcttctctccgtgtctctactctttcttttctctgggcttgcctctttcactatgggcaagcttccaccctccattcccccttcttttccctcagcctgtgttcttaaaaacctaaaacctcttcaactcacacctgacctaaaacctaaatgacttattttcttctgcaatgccacttgaccccaatacaaattcgacagtggttcagaaaatggcactttcaatttttccatcctacaagatctaaataattcttgtcataaaatgggcaaatggtctgaggtgcctgacgtccaggcattcttttacacatcggtccctccctagtctctgttcccaaagcaactcatcccaaatcttccttctttccctcccacctgtcccctcagtcccaaccccaagcatcactgagtctttctaatcttccttttcttcagacccatctgacctctcccctcctcaccaggccaagctaggtcccatttcttcctcagcctctgctccccaaccctataatccttttatcacctcccctcctcacagccggtcaggcttacagttttgttctgcgactagccctcccccacctgcccagcaatttcgtcttacaaaaggtggctggagctaaaggcatagtcaaggttaatgctcctttttctttttccgaactctcccaaaatcagttcacgtttaggctctttttcatcaaatataaaaacccagcccagttcatagctcgtttggcagcaaccctgagacgctttacagccctagaccctgaaaggccagaaggccgtcttattctcaatatgcattttattttattacctaatcttctcccgacattaaataaagctccaaaaattaaattctgaccctcaaaccccacaacaggacttaattaacctcacctgcaagatgtacaataatagagtagaggcagccaagtagcaatgtatttctgagttgcaattccttgcctccactgtgagacaaaccccagccacatctccagcacacaagaacttccaaacacctaaactgcagccgccaggcattcctccaggcctccctcccccaggagcttgctacaagtgctggaaatctggccaccaggccaaggaatgcccacagcccaggattcctccaagtcgtgtcccatctatgtggtaccccactggaaatcgccttttcccccagtccaactcacccggcagccactcccagcacccctggaactctggcccgaggctccctgactccttcccagatcttcttggcttagcggctgaagactgaggctgcccaattgcctcagaagcttcctggaccatcacagatgctttaggttactgtcacagtggagggtaaatccatccccttcttaatcaatacaaaggctacccactccacattaccttcttttcaagggcctgtttccttcgcccccataacgttgtgggtattgacggccaggcttaaacctcttaaaattccccaactctggtgccaatttagacaatactcttttaagcactccttttaattatccccacctgcccagttccctttattaggctgagatagtttaactaaattatctgcttccctgactattcctgggctacagccatgactcattgctgccttttcccccacttcaaagcctccttcacatcctccccttgtatctccccaccttagcccacaagtataagatacctctactccctccttggtgaccgatcatgcaccccttaccatctcattaaaacctaatcacccttaccctggtcaaagccaatatcccatcccataatgcgatttaaaaggattaaagcctgttatcactcacctgctacagcatggccttttaaagcctataaactctccgtacaattcccccattttacctgtcctaaaaccagacaggccttacaggttagttcaggatctgcaccttatcaaccaaattgttttgcctgtccaccccgtggtgccaaacccatatactctcctatcctcaatacctccctccacaacccattattctcttctggatctcaaacatgctttcttggctattcctttgcacccttcatcccagcctctcttcgttttcacttggactgaccctgacacccatcaggctcagcaaattacctgggctgtactgccgcaagacttcacagacagctcccattacttcagtcaagcccaaatttcttcctcatctgttacctatctcagcataattctcataaaaacacacgtgctctccctgccaatcgtgtctgactgatctttcaaaccccaaaaccttctacaaaacaacaactcctttccttcctaggcatggttagtgcggtcagaattcttacacaagagctgggactgtaccctgtaggctttctgtccaaacaacttgaccttactgttttagcctggccctcaggtctgcgtgcggcggccgccgccaccctaatacttgtagaggcccgtaaaatcacaaactatgctcaactccctctctacaattctcataagttccaaaatctgtttttttcctcacacctgacacatatactttctgctccctggcttcttcagctgtactcactctttgttgagtctcccacaattaccattgttcctggcccagacttcaatccggcctcccacactattccggataccacacctgaaccctatgactgtatctctctgatccatctaacattcaccccatttccccatatttccttctttcctgttcctcaccctgaacacacttggtttattgatggtagttccaccaggcctaatcgccacataccagcaaaggcaggctatgctatagtacaagccaccagcccgcctcttggaacctctcatttcctttccattgtggaaatctatcctcacatgaataacttctcagtgttccatctgctattctactactcctcagggattattcaggccccctcccttccctacacatcaagctcaaggatttgcccctgcccaggactggcaactcttaactcttaactccctcttagagtggatagatgatctttgctggcaggggacctgaagttctattctttacttttatgctcactcttattctcattcccattcttatgcctccctctacctctccccagctatctccaccacactatcaaccttactcattctctcctagctgtttctcatccctccttagcgaacaaacactggctttgcatttccctttcttccagcacctaaacagctgtccctccttacatgcagactaggcaacatcttctgtctccctacacctccgaacttcctttaacagccctcacatttaccctcctgaagaactcatttactttctagacaggtccagcaagacctcctcagacatttcacatcagcaagctgccgccctcctctgtacttagttaaaaaaactttctccttatatcaactctactcctcccatatttagacctctcacaacacaaactactattcccgtggccactcacttatgtatctcttggcaaagacccactggaattcccctaggtaaactttcaccttctcaatgttcctttactcttcatctccaaagccctctccttatttacttatacccagccccgcaaataacagtgaaaggttgctcatagacactcaatgttttctcacacaccatgaaaatcgaacctcccctcctacacagttacctcgtcagtccccattacaacctctgatggctgccgccctagctgcatccctaggagtctaggtacaagacacctctttcagcactccttctcatgtttttagtttgcatctccagttttgcctcgcacaatgtctcttcttcctctgtagatcctctacctacatgtgtctacctgctaattggacaggcacatgcacactagttttccttactcccaaaattcaatttgcaaataggaccgaagagctctctgttcccctcatgacaccgacacaacaaaaaagagttattccactaattcccttgcttgtcagtttaagactttctgcctccactattgctctcagtactggaatagcaggaatttcaacctctggcatgaccttccataaccgctctaatgacttctctgctagcatcacagacaggtcacaaactttatcagtcctccaggcccaagttgactctttagctgcagttgtcctccaaaaccaccaaggccttgacttactcactgctgaaaaaggaggactctgtatattcttaaatgaagagtgttgtttttacctaaatcgatctggcctggtatatgacaacataaaaaaactcaaggatagagcccaaaaacttgccaaccaagtaagtaattatgctgaatccccttggacactctctaataagatgtcctaggtcctcccaattcttagttctttaatacctgtttttctccttctcttattccatttagtttttcaattcatacaaaaactgtatccaggccatcaccaataattctacatgacaaatgtttcttctaacaaccccacaatatcaccccttaccacaaaatcttccttcagcttaatctcttccactctaggttcccacgccacccctaatcccgttcaaagcagccctgagaaacatcacccattatctctccataccacccccaaaaatttccaccgttccaacactttaccactatttcattttatttttcttattaatataagaagacagtaatgtcaggcctctgagcccaagctaagccatcatatcccttgtgacttgcacgtacacatccagatggccggttcctgccttaactgatgacattatcttgtgaaattccttctcctggctcatcctggctcaaaagctcccctactgagcaccttgtgacccccccactcttgcccaccagacaacaaccaccctttgactgtaattttcctttaccgatccaaacaaatcttataaaacggcccaacccctatctcccttcactgactctctttttggactcagcccgcctgcacccaggtgaaataaacagccttgttgctcacacaaagcctgttcggtggtctcttcacacggacctgagtgaaa

SEQ ID NO: 199 - DNA, 5642 bp, Homo sapiens
gtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaa

SEQ ID NO: 200 - DNA, 471 bp, Homo sapiens
gtcaggcctctgagcccaagccaagccatcgcatcccctgtgacttgcacgcatcccctgtgacttgcacgtttaagcccagatggcctgaagtaactgaagaatcacaaaagaagtgaatatgccctgccccaccttaactgatgacattccaccataaaagaagtataaatggccggtccttgccttaagtgatgacattaccttgtgaaatcccttttcctggctcctcgtggctcaaaaaactcccccactgagcaccttgagacccccactcctgcccgccagagaacaaaccccctttgactgtaattttcctttacctacccaaatcttagaaaatggccccacccctatctcccttcgctgactctcttttggactcagcccacctgcactcaggtgaaataaacagctttattgctcacacaaagcctgtttggtggtctcttcacacgggcgtacatgaaa

SEQ ID NO: 201 - DNA, 6034 bp, Homo sapiens
gtcaggcctctgagcccaagctaagccatcatatcccctgtgacctgcacatacacatccagatggccaattcctgccttaactgatgacattccaccacaaaagaagtgaaaatggcctgttcctgccttaactgatgacactgtcttgtgaaattccttctcctggctcatcctggctcaaaagctcccccactgagtacctggcgactctcactctgcctgccagagaaaaactcccctttgactgtaattttcctttatctacccaaatcttataaaatggccccacccttatctccctcccctgactttcttttcagactcagcccacctgcaccaggtgaaataaacagccatgttgctcacacaaagcctgtttggtggtctcttcacacagacgtgcatgaaatttggtgctgtgactcggatcgggggacctctcttgggagatcaatcccctgtcctcctgctctttgctccgtgagaaagatccacatatgacctcaggtccttaaaccaaccagcccaagaaacatctcaccaatttcaaatccagtaagcggcctctttttactctcttctccaacctccctcactatcccttaacctctttctcctttcaatcttggtgccacacttcagtctctcccttctcttaatttcaattcctttcattttctggtagagacaaaggagacacattttatctgtggacccaaaactctggcgccggtcacggactagggaaggcagccttccctgggtgtttaatcattgcagggacacctctctgattattcaccaaagtttcagaggtgtcagaccacgcagggatgcctgccttggtccttcacccttagcggcaagtcccgcttttctggggaaggggcaagtaccccaaccccttctctccctgtctctaccacttcttcacctttctagggggcaagaaacccccaaccccttcttcacccttagcagcaagtcccacttttctaggggagaggcaagtaccccaaccccttatatctctctgccccgatcccttaattccgtgccccaaccccttatatctctgtgccccgatccctaatttccgcaccccaaccccttatatgtctgcgccctgatcccttatttccgtgccctgacctcatatctctgtgcctcgacccctttcccacttttctggagggtaagaacccccgaaccccttccctccctgtctctactctctcttttctctaggcttgcctccttcactataggcaaccttccaccctccattcctccttcttctcccttagcctgtgttcttaagaacttaaaatctcttcaactcttacctgacctaaaatctaagcaccttattttcttctgcaacaccgcttggccccaatacaaacttgacaatggctctaaatggccagaaaatggcactttcgatttctccttcctacaagacctaaataatatttgtcgaaaaatgggcaaatagtctgaggtgccttgcgtccaggcatttttcacacttcgttccctccctagtctctgttcccaatgcgattcctcccagatcctccttctttccctcccgcctgtcccctcagtcccaaccgcaagtgtcactgaatctttcaagtcttcctttcctacagacccatctgacctttcctctcttccccaggctgctcgtcgccaggccgagctaagtcccaattcctcctcagcctccgctcctccaccctatgatccttctaccacctaccctcctcacacccggtccggcttacagcttagttccgtgactagttcttccccacctgcccaacaatttcctcttagagaggtggctggagctgaaggcatagtcagggtacatgtacctttttctctatcagacctctctcagatcagtcagtgtttaggctctttctcatcagaccccactaaatatgtacaggaattccaatatctaactctgtcctgcaatttaacctggagtgacttaaatatcatcctgacttctaccctctccccagatgaacaggaaagagttttttccctagcccaatctcacgctgataaccgctggcttcatgagccagacctccaggaaggcattagagcagttccccaagaagatccccaaaggaactaccaggcaaattccccaggtatagctaggcgagattacatggtttcctgcctagttgaaaggcttaaaaaggcagcttacaaagctgttaattatgacaagcttcaagaaactacccgaggtaaagatgaaaacccagcccagttcatggcccgcttagcggcaacccttagacgctttaccaccctagacccagaggggccagaaggccgccttattcttaatatacattttattatccaatctgctcccgacattaaataaaactccaaaaattaaattccggccctcaaaccccacaacaggatttaattaacctcgccttcaaggtgtacaataatagaaacaagttgcaattccttgcctccactgtgagacaaaccccagccacatctccagcgcacaagaacttccaaatgcctgaaccgcagtggccaggcgttcctccagaacctcctcccacaggagcttgctacaagtgtcagaaatctgaccaccaggccaaggaatgcctgcagcccaggattcctcctaagccacgtcccatctgtgcaggaccccactggaaatcggaccgttcaactcacctggcagccactcccagagcccctggaactctggcccaaggctctctgactccttcttggcttagcggctgaagactgacgctgccggatcgcctcggaagccccacagaccatcacggatgccgagcttcgggtaactctcacagtggaaggttaagtccgtccccttagtcaatacggaggctacccactccacattaccttcttttcaagggcctgtttcccttgcctccataactgttgtgggtattgacggccaggcttttaaacccctgaaaactcccccactctggtgccaacttggacaacactcttttatgcactcttttttaattatccccacctgcccagttcccttattaggctgagatattttaaccaaattagctgcttccctgactatttctaggctacagccacacctcattgccaccttttccctagttcaaagcttccttcacatcctcgtctcatatccctccaccttaacccacaagtataagatacctctattccctccttggtgaccaatcacacaccccttacaatctcattaaaacctaatcacccttacttccctcaatgccaatatcccatcccacagcacaccttaaaaagattaaagcctgttatcactcgcctgctacagcatggccctttagagcctataaactctccttacaattcccccattttacctgtcctaaaaccagacaaggcttacaggttagttcagaatctgcgccttatcaaccaaattgttttgcctatccaccccgtggtgccaaacccgtatactctcctatcctcagtacctccctctacaacccattattctgttctagatctcaaacatgctttctttactattcctttgcacccttcatcccagcccctcttcgctttcacctagactgaccctgacacccattaggctcagcaaattacctgggatgtactgccgcaaggcttcacagacagaccccattacttcagtcaagaacaaatttcatcctcatctgttacctatctcagcataattctcataaaaacacacgtgctctcccgctgatcgtgtccaattaatctcccaaacctcgatcccttacaaaacaacaactcctttccttcctaggcatggttagtgcggtcagaattcttacagaagagccaggaccacaccctgtagcctttctgtccaaataacttaaccttactgttttagcctagccctcatgtctgcgtgcagcagctgccgctgcattagtacttttagaggccctaaaaatcacaaactatgctcaactcactccctacatttctcataacttccaaatctattttcttcctcatacttgacgcatatactttctgctccccggctccttcagctgtactcactctttgttaagtcccacaattaccattatgcctggcccggacttcaatccggcctcccacattattcctgataccacacctgacccccatgactgtatctctctgatccacctgacattcaccccatttccccatatttccttctttcctattcctcaccctgatcacgcttgatttattgatggcagttccaccaggcctaatctccacacaccagcaaaggcaggttatgctatagtacaagccactagcccgcctctttgaacctctcatttcctctccatcgtggaaatctatcctcaaggaaataacttctcagtgttccatctgctattctactactcctcaaggattattcaggccccctcccttccctacacatcaagctcgaggatttgccccacccaggactggcaaattagctttactcaacatgccccgagtcagataactaaaatacctcttagtctaggtagacactttcactggataggtagaggcctttcctacagggtctgagaaggccactgcagtcatttcttcccttctgtcagacataattcctcagtttagccttcccacctcaatacagtctgataacagacctgcctttattagtcaaatcagccaagcagtttttcaggctcttggtattcagtgaaacctttatatcccttacagtcctcagtcttcaggaaaagtagaacggactaaaggtcttttaaaaccacacctcaccaagctcagccaccaacttaaaaaggactggacaatccttttaccaccttcgcttctcagaattcaggcctgtcctcggaatgctacagggtacagcccatttgagctcctgtatagacgctcctttttattaggccccagtctcattccagacaccagaccaccttagactgtgccccaaaaaaacttgtcatccccactatcttctgtctagtcatactcctattcaccgttctcaactactcatacatgccctgctcttgtttacactgccagtttacacagtttctccaagccatcacagctgatatctcctggttctatccccaaactgccactcttaactcttgaagtaaataaataatctttgctggcaggactatgctgaatctccttaggcactgtctaatcagatgtcctgagtcgtcccaattcttcgatcttttatacctgtttttctccttctcttcttccatttagtttttcaattcatagaaaactgtatccaggccatcaccaataattctaaatgacaaatgttccttctaacaaccccacaatatcactccttaccacaaaatcttccttcagcttaatctctcccactctaggttcccacaccaccccaatcccgcttgaagcagccctgagaagcatcgcccattatctctccataccacccccaaaaattttcactgtcccaacacttcaacactatttcattttatttttcttattaatataagaagacaggaatgtcaggcctctgagcccaagctaagccatcatatcccctgtgacctgcacatacacatccagatggccgattcctgccttaactgatgacattccaccacaaaagaagtgaaaatggcctgttcctgccttaactgatgacattgtcttgtgaaattccttctcctggctcatcctggctcaaaagctcccccactctgcccgccagagaacaactcccctttgactgtaattttcctttatctacccaaatcctataaaatggccccacccttatctcccttccctaactctcttttcggactcagcccacctgcacccaggtgaaataaacagccatgctgctcacacaaagcctgtttgctggtctcttcacacggatgcacatgaaa

SEQ ID NO: 202 - DNA, 999 bp, Homo sapiens
tgtgcaggtgtacctagcagctccaaagagacagcgaccatcgaggacaagccatgatgacaatggtggttttgtcaaaaagaaaagggggaaatgtggggaagagaaagagagatcagactgttactgtgtctatgtagaaagaagtagacataagagactccattttgttctgtactaagaaaaattattttgcctcgagatgctgttaatctgtaaccctacccttaaccctgtgctggcagaaacacgtgctgtgacgactcaaggtttagtggatttagggctatgcaggatgtgctttgttaaacaaatgcttgaaggcagcatgcttgttaaaagtcatcaccactccctaatctcaagtacccggggacacaaaacactgtggaaggctgcagggacctctgcctaggaaagccaggtattgtccaaggtttctccccatgtggtaatctgaaatatggcctcgtgggaagggaaagacctgaccgttccccagcccgacacccgtaaagggtctgtgctgaggaggattagtaaaagaggaaggcctctttgcagttgagataagaggaaggcatctgtctcctgctcgtccctgggcaatagaatgtctgggtgtaaaacccgattgtatattccatctactggagataggagaaaaccgccttagggctggaggtgagacatgctggcggcaataggcaatagtgctctttaaagcattgagatgtttatgtatgtgcacattaaaagcacagcacctttttctttaccttgtttatgatgtagagatgtttgttcacgttttcctgctgaccctctccccactattaccctgttgtcctgccactctccattgtctccctgttgtccccctctccgatatggtagagatactaatgaataaatactgagggaactcagagaccggtgccggcgtgggtcctccatatgctgaacgccggttccctgggcccacttttctttctctat

SEQ ID NO: 203 - DNA, 4364 bp, Homo sapiens
gtcaggcctctgagcccaagccaagccatcgtatcccctgtgacttgcacgtatacgcccagatggcctgaagtaactgaagaatcacaaaagaagtgaaaaagccctgccccgccttaactgatgacattccaccattgtgatttgttcctgccccaccttaactgagtgattaaccctgtgaatttccttctcctggctccgaagctcccgcactgagcaccttgtgacccccgcccctgcccaccccatctcccttcgctgactctctttttggactcagcccacctgtacccaggtgaaataaacagctttattgctcgcacaaagcctgtttggtggtctcttcacacggacgtgcatgaaatttggtgccgtgactcgaatcgggggacctcccttgggagatcaatcccccgtcctcctgctctttgctccctgagaaagatccacctacgacctcaggtcctcagaccgaccagcccgagaaacatctcaccaatttcaaatccggtaagcagcctctttttactctcttctccaacctccctcactatccctcaacctccttctcctttcaatcttggcgccacacttcaatctctcccttctcttaatttcaattcccttcattttccggtagagacaaaggagacacattttatccgtggacccaaaactctggtgccggtcacggactcaggaaggcagccttcccttggtgtttaattattgcagggacacctctctgattatttacccacgtttcaaaggtgtcagaccacgcagggatgcctgccttggtctttcgcccttagtggcaagtcccgcttttctggggaaggggcaagtaccccaaccccttctctccttgtctctaccccttctctgcttttctggggaaggggcaagtaccctaaccccttctctccttgtctctaccccttctctgctttactggggcaggggccagtacccctcaaccccttctccttcacccttagtggcaagtcccactttcctagggggcaagaaccccccaatcacttatttctgcaccccaacctcttatctctgtgccccaatcccttatttccacaccccgacctcttatctctgtgccccaattccttatttccatgccccaaccctttctctgcttttctggagggcaagaacccctcaccccttctctgtgtctctactcttttctctgggcttgcctccttcactatgggcaagcttccaccttccattcctccttcttctcccttagcctgtattcttaagaacttaaaacctcttcaactgtcacctgacctaaaatcaaagcgtcttattttcttctgcaatgccgcttgaccccaatacaaactcgacagtagttccaaatagccagaaaatggcactttcaatttttccatcctacaagatctaaataattcttgtcataaaatgggcaaatggtctgaggtgcctgacgtccaggcattcttttacacatcagtcccttcctagtctctgtgcccagtgcaactcgtcccaaatcttccttctttccctccctcctgtcccctcagtcccaaccccaagcgtcgcagagtctttctaatcttccttttctacagacccatctgacctctcccctcctcgccaggccaagctaggtcccaattcttcctcagcctctgctcctccaccctgtaatctttttatcacctcccctccacacctggtccggcttacagttttgttccgtgactagccctcccccacctgcccagcaatttactcttaaaaaggtgcctggagctaaaggcatagtcaaggttaatgctcctttctctttatcccaaatcagatagcgtttaggctctttttcatcaaatataaaaatccagcccagttcatgatttgtttggcagcaaccctgagacgctttacagccctagaccctaagaggtctaaaggccgtcttattctcaaaatgcattttattacccaatctgctcccgacattaaataaaactccaaaaattggaatctggccattaaaccccacaacaggacttaattaacctcaccttcaatgtgtacaataacagaaaaaagttgcaattccttgcctccactgtgagataaaccccagccacatctccagcacacaagaacttccaaacgcctgaaccgcagcagccaggcgttcctccagaacctcctcccccaggagcttgctacatgtgccggaaatctggccactgggccaaggaatgcccacagcccgagattcctcctaagccacgtcccatctgtgtaggaccccactgaaaagcggactgttcaactcatctggcagccactcccagagcccctggaactctggcccaaggctctctgactgactccttcccagatcttctcggcttagcggctgaagactgacgctgcctgatcgcctcggaagccccctagaccatcacggacgccgagcttcaggtgactctcacagtggaaggtaagcccatccccttcttaatacggaggctacccactccacattaccttcttttcaagggcccgtttcccttgcctccagaactgttgtgggtattgacggccaggcttctaaacctcttaaaactccccaactctggtgccaacttagacaatactcttttaagcactccttttaattatccccacctgcccggttcccttattaggctgagacactttaactaaattatctgcttccctgactattcctggactacagctatatctcattgccgcccttctccccaacccaaagcctccttcgcgtcttcctctcatatccccccaccttaacccacacatatgggacttctctactccttccctggcaaccgatcacatgtccattaccatcccattaaaacctaatcacccttaccccactcaacgccaatatcccatcccgcagcatgctttaaaaagattaaagcctgttatcactcaactgctacagcatggccttttaaagcgtataagctctccttaccattcccccattttacctgtcctaaaaccagacaagccttacaagttagttcagaatctgcgccttatcgaccaaattgttttgcctatccaccccatggtgccaaacccatatactgtccaatcctcaatacctgcctctacaacccattattctgttctagatctcaaacatgctttctttactattcctttgcacccttcatcccaacctctctttgccttcacttagactgaccctgacacccattaggctcagcaaattacctgggctgtactgccgcaaggcttcacagacagcccccattacttcagtcaagcccaaatttcatcctcatctgttagtcatactactattcatcgttctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagtccttttatacctgtttttctccttcccttattccatttagtttttcaattcatacaaaaccatatccaggccatcaccaatcattctatacgacaaatgtttcttctaacatccccacaatatcaccccttaccacaagatctcccttcagcttaatctcccccactctaggttcccacgctgcccctaatctcgcttgaagcagccctgagaaacatcgcccattctctctccataccaccctcaaaaattttcgctgccccaacacttcaacactattttgttttatttttcttattaatataagaaggcaggaatgtcaggcctctgagcccaagccaagccatcgtatcccctgtgacttgcacgtatacgcccagatggcctgaagtaactgaagaatcccaaaagaaatgaaaaggccctgccccgccttaactgatgacattccaccactgtgattggttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaacagccccacccctatctcccttcactgactctcttttgggactcagcccacctgcacccaggtgaaataaacagctttattgctcacacaaagcctgtttggtggtctcttcacagggacgcacatgaaa

SEQ ID NO: 204 - DNA, 665 bp, Homo sapiens
ttaaagtaggtagctagtcaggcatgagaagtgtaagagagggctccccccactccatcaggaatgtcaggcgaccatcaggtgatggtcaggcagttgtcacactgtctctctaaaataataattagtcacagccagtgccagggaaaggcagtctccatagataaaaacacctgaaactggtgatcagcagcttttggataagatttcagcagttgggccagtaggctcgagcatgcatattaagagccaaaatggtaccatttaactggtatataaccatcgggggcattccactggtaaggaaagaatgcctcaaatgagcatgcatacaactccagtaaacacactgctcgtgctcccctcccaagtgctagcaggccactgtgcatgtggacaacccactctgagggaagaatcagggaagaagggacgcaagaccccagaagagtgttaatatataaaaccccaagtcaaaaggtcaaactgtgcacttgtctatcaagttgcctgcttggccctctaccaagtatatgttctttccttttgttcctgctctaaagctttttaataaactttcacttctgctctaaaccttgccttggtctctccttctgccttatgcctccttggtcgaattctttcttctgagggggcaagaattg

SEQ ID NO: 205 - DNA, 9629 bp, Homo sapiens
gtcaggcctctgagcccaagctaagccatcatatcccctgtgacctgcacgtacacatccagatggccggttcctgccttaactgatgacagtccaccacaaaagaagtgaaaatggcctgttcctgccttaactgatgacattatcttgtgacattccttctcctggctcatcctggctcaaaagctcccctgctgagcaccttgtgacccccactcctgccctccagagaacaacccccctttgactgtaattttcctgtatctacccaaatcttataaaacggccccacccttatctcccttcgctgactctgttttcggactcagcctgcctgcacccaggtgaaataaacagctttattgctcacacaaagcctgtttggtggtctcttcaaacagacgcgagtgaaatttagtgctgtgacatggatcgggggacctcccttgggagatcaatcccctgtcctcctgctctttgcttcgtgagaaaggtcaacctacgacctcaggtcctcagaccgaccagctcaaggaacatctcaccaatttcaaatccggtaagcagcctcttttcacactcttctccaacctccctcactatccctcaacctctttctcctttcaatcttggtgccatacttcaatctctcccttctcttaatttcaattcctttcatcttctgttagagacaaaggagacacattttatccatggatccaaaactctggcgccggtcacggagtgggaaggcggccttcccttggtgtttaatcattgcagggacgcctctctgattattcatccacgtttcagaggtctcagaccacgcagggacgcctgccttggtccttcacccttagcggcaagtcccgcttttctgggggaggggcaagtaccccaaccccttctctccatgtctctaccccttctccacttttctgggggacgggcaagaacccctcaactccttctccttcaccctcggcggcaagtcccgcttttctagagggcaagaatccccaatcccttatttccgtgccccgacctcttatctctgcaccccgatcccttatttccatgctccgacctcatatctctgtgccccaatcccttatttccgtgcctcaacctcgtatctctgtgacctgacccctttcccatttttctggaaggtaagaacccctgaaccatttccctctgtgtctctactctcccttttctttaaacttgcctcctttactgtaggcaaccttccaccctccattcctccttcttctcccttagcctgtgttcttaggaacataaaacctcttcaactctcacctgacttaaaatgtaaatgccttattttcttctacaatgctgcttgaccccaatagaaactcgacagtggttctaaatggccagaaaatggcacttgcgatttctccatcctacaagacctaaataatttttgtcaaaaaataggcaaatggtctgagatgcctgacgtccaggcattcttttacacatcggtccttccctagtctctgtgcccagtgcaactcttcccaaatattccttctttccctcccgcctgtcccctcagtcccaaccccaagtgtcactgagtctttctaatcttccttttctacagacccatctgacctctcccctcctccccagactgctcctagccaggccaaactaggtcccaattcttcctcagcctccgctcctccaccctataatctttttatcacctcccctcctcacaccgagtccagtttacagtttcattccgtgagtagccctcccccacttgcccagcaatttcctcttaaaaaggtggctgaagctaaaggcatagtcaaggttaatgctcctttttctttatcagacctctcccaaatcagtgagcgtttaggctctttcatcaaatatgaaaaacccagcccagttcatagccgtttggcagcaaccctgagacgctttacagccctagaccctaaaatgtcagaaggccgtcttattctcaatatacattttgttacccaatctgctcccgacattaaataaaactccaaaaattaaattccagccctcaaaccccacaacaggacttaattaacctcgccttcaaggtgtacaataatagagtagaggcagccaagtagcaacatatttctgagttgcaattctttgcctccactgtgagacaaaccccagccacatctccagcacacaagaactccaaacacctgaaccgcagctgccaggggttcctccagaacctcctcccccaggagcttgctacaagtgctagaaatctggccactgggccaaggaatgcccacagcccaggatccctcctaagccatgtcccatctgtgcaggtccccactgaaaattggactgttcaactcacctggcagccactcccagagcccctggaactctggcccaaggctctctgactgactccttcccagatcttctcagcttagcagctgaagactgacactgcccgatcaccttgggtgcctacaggatcatcacagatgctctagataactctcacagtggagggtaagtccatccccttcttaatcaatacataggctactcactccacattaccttcttttcaagggcctgtttcccttgcctccataactgttgtgggtattgatggccaaggttctaaacctcttaaaactccccaactctggtgccaacttagacaatagtcttttaagcactcctttttagttatccccacctgcccagttcccttattaggccgagacactttaactaaattatctgcttccctgactattcctgggctacagccacacctcattgccgccttttcccccagttcagagcctccttcacatcctccccttgtatctccccaccttaacccacaagtataagacacctctactccctccttagcgaccaaacatgcaccctttaacatcccattaaaacctaatcactcttaccccgctcaatgccaatatcccatcccacagcatgctttgaaaggattaaagacctttatcactggcctgttatagcattgccttttaaagcctataaactcttcttaccattcccccattttacctgtcctaaaaccagacaaggcctacagcttagttcagaatctgtgccttatggacaaaattgttttgcctatccaccctgtggtgccaaacccatatactctcctatcctcaatacctccctctacaacccattattctgttctggatctcaaacatgctttctttactattcctttgcacccttcatcccagcctctctttgctttcacttagatgaccctgacgcccattaggctcagcaaattacctgggctgtactgccacaaggcttcacagacagcccccattacatcagtcaagcccaaatttcatcctcatctgttacctatctcggcataattctcataaaaacacatgtgctctccctgctgatcgtgtccgattaatctcccaaacctcaatcccttataaaacaacaactcctttccttcctaggcatggttagtgcagtcagaattcttacacaagagccaggacagcaccctgtagcctttctgtccaaacaacttgaccttactgttttagcctagccatcatgtctctgtgcagaggctgctgctgccctaatacttttagaggccctcaaaatcacaaactatgctcatctcactctcaacagttctcataacttccaaactctatattttcttcctcatacctgacacatatactttctgctccccggctccttcagctgtactcactctttaagtcccacaattaccattgttcctggcccggacttcaatccggcctcccacattattccggataccacacctgacccccatgactgtatctctctgatccacctgacattcaccccatttccccatatttccttctttcctgttcctcaccctgatcacacttggtttattgatggcagttccaccaggcctaatggccacacagcagcaaaggcaggctatgctatagtacaagccactagcccgcctcttagaacctctcatttcctttccattgtggaaatctatcctcaaagaaataacttctcagtgttccatctgctattctactactcctcagggattattcaggacccctcccttccctacacatcaagctcagggatttgcccccacccaggactggcaaattggctttactcaacatgccccaggtcagaaaactaaaatacctcttagtctaggtagacactttcactggataggtagaggcctttcctacagggtctgagaaggccaccagtcatttcttcccttctgtcagacataattcctcagtttagccttcccacctctatacagtctgataacagaccagcctttattaatcaaatcagctaagcagtttttcaggctcttagtatccagtgaaacttttatatcccttatggtcctcagtcttcaggaaaggtagaacggactaaaggtcttttaaaaacatacctcaccaagctcagccaccaacttaaaaaggactagacaatacttttaccactttcccttctcagaagtcagacctgtcctcagaatactacagggtacagcccatttgagctcctgtatagatgctcctttttattaggccccagtctcattccagacaccagaccaacttagactgtgcccccaaaaaacttgtcatccctactatcttctatctagtcatactcctattcaccgttctcaactactcatatatgccctgctcttgtttacactgccggtttacactgtttctccaagccatcacagctgatatctcctggtgctatccccaaactgccactcttaactcttaaagtaaataatctttgctggcaggactatgctgaatctccttaggcactctctaatcagatgtcctaggtcctcccaattcttagaccttttatacctgtttttctcctcttattccatttagtttttcaattcatacaaaaccgtatccaggccatcaccaatcattctacacgacaaatgtttcttctaacaaccccgtaatatcaccccttaccacaaaatcttccttcagcttaatctctcccactctaggttcccacgccgcccctaatcccactcgaagcagccctgagaaacatcgcacattatctctccataacacccccaaaaattttcagcgtcccaacattttaccactatttcattttatttttcttattaatataagaatacaggaatgtgaggcctcagagcccaagctaagccatcatatcccctgtgacctgcaggtacacatccagatggccagttcctgccttaactgatgacattccaccacaaaagaagtgaaaatggcctgttcttgccaaaaccgatgacattgtcttgtgacattccttctcctggctcatcctggctcaaaagctcccctactgagcaccttgtgacccccactctgaccgccagagaacccccctttgactgtaattttcctttacctacccaaatcttataaaacggctccacccttatctcccttcgctgactctttttggactcagcccacctgtacccaggtgaaataaacagctttattgctcacacaaacctgtttggtggtctcttcacatggacgcgagtgaaattctcaatatacattttattacccaatctgttcccgacattaaataaaactccaaaaattaaatcccggccctcaaaccccacaacaggacttaattaacctcgccttcaaggtgtacaataatagagtagaggcagccaagtagcaacatatttctaagttgcaattccttgcctccactgtgagacaaaccccagccacatctccagcacacaagaacttccaaatgcctcaaccgcagcggccaggatttcctccagaactgcctccccaggagcttggtacaagtgccagaatgtaccaggccaaggaatgcccgcagcccaggattcctcctaggccgtgtcccatctctgcaggaccccactgaaaatcagactgttcaactcacctggcagccactcccagagcccctggaactctggaccaaggatctctgactccttcccagatcttcttggcttagctgctgaagactgacgctgcccgatcgcctcagaagccctgtggaccatcacagacgccgagctttaggtaattctcacagtggagggtaagtccgtccccttcttaatcaatatggaggctactcactccacattaccttcttttcaagggcctgtttcccttgcctccataactgttgtgggtattgacggccaggcttctaaacctcttaaatctccccaactctggtgccaacttagacaatagtcttttaagcactcctttttagttatccccacctgcccagctcccttattaggctgagacactttaactaaattatctgcttccctgactattcctggactacagctacatctcatcgccgtccttcttcccaatccaaagcctcctttgcgtcctcctcttgtatccccccaccttaacccacaagtataggatacctctactccctccttagcgaccaatcatgcaccccttagcatctcattaaaacctaatcacccctaccccgctcaatgccaatatcccatcccacagcatgctttagaaggattaaagcctgttatcactcacctgttacagcatggccttttaaagcctataaactctccttacaattcccccattttacctgtcctagaaccagacaaggcttacaggttagttcaggatctgtgccttatcaaccagattgttttgcctatccacccagtggtgccaaacctatatactctcctatcctcaatacctcccttcacaacccattattctgttctggatctcaaacatgctttcttcactattccttttcacccttcatcccaccctctctttgatttcacttggactgaccctgacacccatcaagctcagcaaattacctggactgtactgccgcaaggcttcacagacagcccccattacatcagtcaagcccaaatttcttcctcatctgttacctatctcagcataattctcataaaaacacacgtgctctccctgccaatcatgttcagctgatctctcaaaccccaacacctataaaacaacaactcctttccttcctaggcatggttggatactttcgactttagacacctggttttgccaccctaacaaaaccattacataaactcacaaaaggaaaccttgctgaccccatagatcctaaatcctttccccactcctctttccattccttaaagacagctttagagactgcccccatcctagctctccctggctcatcccaacccttttcattatccacagccgaagtgcagggctgtgcagtcagaattcttacacaagaaccgggactgcgccctgtagactttttatccaaacaacttgaccttactgttttgcctagccctcaagtccgcttgtggtggccgccaccaccctaattcttttagaggcccttaaaatcacaaactatgctcaactcactctctacagttctcataacttccaaaatctattttcttcctcacacctgacacatatactttctgatccctggctccttcagctgtactcactctttgttaagtctcccacaattaccattgttcctggcccggacttcaatccggcctcccacattattctggataccacacctgacccccatgactgtatctctctgatccacctgacattcaccccatttccccatatttccttctttcctgttcctcaccctgatcacacttggtttattgatggcagttccaccaggcctaatggccacacaccagcaaaggcagggtatgctatagtataagccaccagcccacctcttagaacctctcatttcttttccatcgtggaaatctatcctcaaagaaataacttctcagtgttccatctgctattctactacttctcagggattattcaggccccctcccgtccctacacatcaagctcagggatttgcctcctcccaggactggcaaattagctttactcaacatgcccggagtcaggaaactaaaatacctcttggtctaggtagacactttcactggataggtagaggcctttcccagagggtctaagaaggccaccacggtcatttcttcccttctgtcagacataattcctcagtttagccttcccacctctatacagtccgatagcagacctgctttattggtcaaataagccaagcattttttcaggctcttggtattcagtgaaacctttatatcccttacggtcctcagtcatcaggaaaggcagaacgggctaatggtcttttaaaacctctccaagctcagccaccaacttaaaaaggactagacaatacttttaccactttcccttctcaaaattcaggcctgtcctcagaatgctacagggtacagaccatttaagctcctgtatagacgctcttttttattaggccccagtctcattccagacaccagaccaacttggactgtgccccaaaaaacttgtcatccctactatcttctgtctagtcatactcctattcaccgttctcaactactcatacatgccctgctcttgtttacactgccggtttacactgtttctctaagccatcacagctgatatctcctggtgctatccccaaactgccactcttaactcttaaagtaaataaataatctttgctgaaaaggctatgctgaacctccttaggcactctctaattatatgtcctaggtcctcccaattcttagtcctttaatacctgtttttctcctcttattccgtttttcaattcgtacaaaaccgtatccaggccatcaccaataattccaaatgacgaacgtttcttctaacaaccccacaacatcaccccttaccacaaaatcttccttcagcttaatctctcccactgtagattcccacgccgcccctaatcctgctcaaagcagccctgagaaacatcgcccattttctctccataacacccccaaaaatttttgccgtcccaacattttaccactgtttcattttatttttcttattaatataagaagacaggaatgtcaggcctctgagcccaagctaagccatcatatcccctgtgacctgcagtacacatccagatgaccagttcctgccttaactgatgacattccaccacaaaagaagtgaaaaggcctgttcctgccttaactgatgacattatcttgtgaaattccttctcctggctcatcctggctcaaaagctcccctgctgagcaccttgtgacccccccccacacctgcccgccagagaacaaaccccctttgactgtaattttcctttacctacccaaatcttataaaacggccccaccggtatctcccttcactgactctcttttcagactcagcctgcctgcacccaggtgattaaaagctttcttgctcacacaaagcctgtttggtggtctcttcacagggatacgagtgaaa

SEQ ID NO: 206 - DNA, 967 bp, Homo sapiens
gtggggaaaagaaagagagatcagattgttgctgtgtctgtgtagaaagaagtagacataggagactccattttgttctgtactaagaaaagttcttctgccttgagatgctgttaatttataaccttacccccaaccccgtgctctctgagacatgtgctgtgtcaactcagggttaaatgaattaagggctgtgcaagatgtgctttgttaaacagatgcttgaaggcagcatgctccttaagagtcatcaccactccctaatgtcaagtgcccagggacacaaacactgcggaaggccgcagggacctctgcctaggaaagccaggtattgtccaaggtttctccccatgtgatagtctgaaatatggcctcgtgggaagggaaagacctgaccgtcccccagcctgacacccttaaagggtctgtgctgaggaggattagtataagaggaaggaatgcctctttgcagttgagacaagaggaaggcatctgtctcctgcccgtccctgggcaatggaatgtctcggtataaaacccgattgtatgttccatctactgagatagggaaaaaccgccttagggctggaggtgggacacgcgggcagccatactgctttgtaaggcattgagatgtttatgtgtatgtgtatctaaagcacagcacttaattctttaccttgtctatgatgcagagacctttgttcatgtgtttatctgctgaccttctctccactattatcctatgaccctgacacatccccctctccgagaaacacccaagaatgatcaataaatatgaagggaactcagaggccggcagcatcctccatatgctgaacgcaggtaccctgggcccccttatttctttgtctgtactttgtctctgtgtctttttcttttccaagtctctcgttccacttaacgagaaacacccacaggtgtggaggggcaacccaccccttca

SEQ ID NO: 207 - DNA, 700 bp, Homo sapiens
ctagtcagacatgagcaaggcaggataggcacccctccacccccacccccaccacccacacacacaccaggaatgttaggcaatgatcaggtgatggtcaggtgactgttaaactgtcttgttaaaataataattggtttcagccagagccaggggaaggctttctcccaataaacagaaacacctgaaactggtgatcagcagcttcctgatcccaggagctgggtaagtgggctcaagtatgcacattacaaggcaaaatggcaaagcttaactggtatatgacctttagagacatttgactggcaagggaagaatgtctcaagtgaacatgtgtacaattccagtaaacacactgtgcgtgctccccgccccagcactagcaggccactgtgcatgtggacagcccaccccaagggaagaatcaggggataagggacacaaagccccagaagtatgccagcgtctaaaaccccaagtcaaaaggtcaaaactgcacacttgatctctcaagtcaccttcttggccctcttccaagcgtactttccttcctttcattcctgctgtaaagctttttaataaactttcactcctgctctaaaacttggcttggtctccttttctgctttatgcccctcagctgaattctttcttctgaggaggcaagaattgaggttgctgcagaccattatggattcgc

SEQ ID NO: 208 - DNA, 4136 bp, Homo sapiens
gtcaggcctctgagcccaagctaagccatcatatcccctgtgacttgcatgtatacatccagatggcctgaagtaactgaagaataacaaaagaagtgatgtttaaatggcctgttcctgccttaactaatgacattccaccacaaaagaagtgaaaatggccggtgcttgcccttaaatgatgacattaccttgtgaaattccttctcctggctcatcctggctcaaaaagctcccccactgagcaccttgtgaccacactcctgccctccagagaacaacccccctttgcctgtaattttcctttacctaccgaaatcttacaaaatggccccacccctgtctcccttcgctgactctctttgcggactcagccagcctgcacccaggtgaaataaacagccttgttgctcacacaaagcctgtttaatggtctcttcacactggcgcgagcgaaattttggtgccaggactcggatcgggggcctcccttgggagatcaatcccctgtcctcctgctctttgtttcgtgagaaagatccacatacgaccttgggtcctcagaccgaccagcccaaggaacatctcaccaattttaaatctggtaagcggcctctttttactctcttctccaacctctctcactatccctcaacctctttctcctttcagtcttggtgccacacttcaatctctcccttgtcttaatttcagttcctttcattttctggtagagacaaaagagacacgttttatctgtggacccaaaactccagccctggtcacagacttgggaagacagtcttctcttggtgtttaatcacgcagggatggctgcctgattattcacccacgtttcagagttgtctgaccacacggggatgcctgccttggtccttcacccttagcagcaagtaccgcttctctggggggcaggaaccccccaaccccttctctccatgtctctaccccttctctgcttttctggagcgcaagaaacccccgaccccttctctccatgttgctaccccttctccgcttttctggggggcaagaaccccccaccccttctctccatgtctctactctctcttttctctgggcttgcctccttcactatgggcagccttccatcctccattcctccttcttctcccttagtctgtgctctcaagaacttaaaacctcttcacctcacacctgacctaaacctaaacgccttatttgcttctacaatgccgcttgaccccaatacagactcgacagtggttccaaatagccagaaaacagcacttttgatttttccatcttacaagatctagatatttcttaccataaaataggcaaatggtctgaggtgcctaacgtccaggcattcttttacacattgttccctccctagtctctgtccccagtgtgactcgtcccaaatcctccttctttccctcccgcctgtcctctcagtcccaaccccaagcatcactctttctaatcttccttttctacagacccatctgacatcccccctcctccccaggccgagccaagtcccaattcttcctcagcctctgctccccctaccctataatccttttatcacctcccctcctcacacccagtccagcttacagtttcgttccacgactagccatcccccacctgcccagcaatctcctcttaaaaaggtggctggaactaaaggcaaagtcaaggttaatgctcctttttctgtatctgacccctcccagaatcagttagtctttcagctcttttttcatcaaatatgaaaaacccagcccagttcatgacccgtttagcagtaaccctgagacactttacagccctagaccctgaaaggtcaaaataccatcttattctcaatatacattttattttattacccaatctgctcctgacattaaataaagctccaaaaattaaattccagccctcaaaccccacaacaggacttaattaatctcgccttcaaggtgtacaataatagaatagaggcggccaagtagcaacttgtttctgagttgcaattccttgcctccactgtgacagaaaccccagccacatctccaggacacaagaacttccaaacgcctaaaacgaagtggccaggcattcctccaggcccgcctgccccagaagcttgctacaagtgccagaaatctggccaccgggccaaagaatgcccacagcccgggattcctcctaagccacgtcccatctgtgtgggaccccactggaaatcggactgtccaactcacctggcagccactcccagagcccctggaactctggcccaaggctctctgactccttcccagatcttctcagcttagcagctgaagaccgacgctgcctaatcacctcggaaccttcccagaccatcacagatgctttaagtaacgttcacagtggaaggttaagtccgtccccttcttaatcaatacggaggctacccactccacattaccttcttttcaaagccctgtttcctttgcctccataactgctgtgggtattgacggccaggcttctaaacctcttaaaactccccaactctggtgccaacttagacaatactcttttaagcactccttttagttatccccacctgcgcagttcccttattaggctgagatattttaactaaatcatctgcttccctgactattcctgggctacagccacatctcattgccaccttttcccctagttcaaagcctccttcacatcctccccttgtatctccccaccttaaaccacaagtataggacgcctctactccctccttggcgacggatcatccaccccttaccatctcattaaaatctgatcacccttaccccactcaatgccaatatcccatctcgcagcacgctttaaaaggattaaagcctgttatcactcgcctgctacagcatggccttttaaagcctataaactctcgttacaattccccattttacctgtcctaaaaccagacaagccttacaggttagttcaggatctgcgccttatcaaccaaattgttttgcctttccaccccatggtgccaaacccatatactctcctatcctcaatacctccctctacaacccattatcctgttctggatctcaaacatgctttctttactattcctttgcacccttcatcccagcctctgttcactttcacttggactgaccctgacacccattaggctcagcaaattacctgggctgtactgccgcaaggtttcacagacagctcccattacttcagtcaagcccaaatttcttcctcatctgttacctatctcggcataattctcatgaaaacacatgtgctctccctgccagtcgtgtctgactgatctctcaaaccccaacaccttctacaaaacaacaactcgtttccttcctagacatggttggatactttcgactttagatacctggttttgccatcctaacaaagtgcaaaaagaaacctagctgaccccatagatcctaaatcctttccccactcctctttccatttcttgaagacagctttagagactgccccctagctctagagtccctagctctccctgactcatcccagcccttttcattacccacagctgaagtgcagggctgtgcagtaagaattcttacacaagaaccgggaccatgccctgtagcctttttatccgaacaacttgaccttactgttttccccagctctcaagtctatgtgcagcggccgctgccaccctaatacttttagaggcccttaaaatcaccaactatgctcaactcactctctaaagttctcataacttccaaaatctattttcttcctcacacctgacacatatactttctgctccccggctctttcagctgtactcactctttattgagtctcccacaattaccattgttcctggcccggacttcaatccggcctcccacattattcctgataccacacctgacccccatgactgtatctctctgatccacctgacattcaccccatttccccaaatttccttctttcctgttcctcaccctgatcacacttggtttattgatggcaggtccaccaggcctaattgccacacacaagcaaaggcaggctatgctacagca

SEQ ID NO: 209 - DNA, 3534 bp, Homo sapiens
gtcaggcctctgagcccaagccaagctatcgcatcctctgtgacttgcacgtatatgcccagatggcctgaagtaactgaagaatcacaaaagaagtgaatgtgtcctgccccaacttaactgatgacattccaccacaaaagaagtctaaatggccggtccttgccttaactgatgacattaccttgtgaaagtccttttcctggctcatcctggctcaaaaagcacccccactgagcaccttgcgacccccactcctgcccaccagagaacaaaccccctttgactgtaattttcctttacctacccaaatcctgtaaaacggcctcatccttatctccctttgctgactctctttttggactcagcccgcctgcacccaggtgaaataaacagccatgttgctcacacaaagcctgtttggtggtctcttcacacggacgcgcatgaaatttggtgcctaaatttggtgccatgactcggatcgggggacctcccttgggtgatcaatcccccgtactcctgttctttgctccgtgagaaagatccatctatgacctcaggccctcagaccgaccagcccaaggaacatctcaccaattttaaatcaggtaagcggcctcttcttactctcttctccaacctctctcaccgtccctcaaccactttctcctttccactcttcaatctcccccttctcttaatttcaattcctttcattttctgggagagacaaaggagacatgttttatccgtggacccaaaactccggcgccggtcacggactgggaaggcagccttcccttggtgtttaatcattgcaaggatgcttctctgattatacactcacgtttcaagggtgtcagaccacacagggacgcctgccttagtccttcacacttagcggcaagtcccgcttttctgggggaggggcaagtaccccaaccccttctctgtctctaccccttctctgctttcctggggcaggggcaagtacccttcaaccccttctccttcacccttagcggcaagtcccactttcctagggagcaagaatcccccaatcgcttatttccaaaccccaacctatatctctgcaccccaatcccttatttccgcaccctgacctcttatctctgtgccccaatcccttatttccgtgccccaaccccttctctgcttttctggagggcaagaaccccccaccccttctccatgtctctactcttttctctgggcttgcctccttcactataggtaagcttccaccttccattcctccttcttctcccttagcctgtgttctcaaaaacttaaaacctcttcaactcacacctgatctaaaacctaaatgccttattttcttctgcaatgccgcttgaccccaatacaaactggacagtagttccaaatagccggaaaatggcactttcaatttttccatcctacaagatctaaataattcttgtcgtaaaatgggcaaatggtctgaggtgcctgacatccaggcattcttttacacatcagtcccttcctagtatctatgcccagtgcaactcgtcccaaatcttccttctttccctcccgcctgtcccctcagtcccaaccccaagcatcgctgagtctttctaatcttccttttctacagacccatctgacctctcccctcctcaccagcccaagctaggtcccaattcttcctcagcctccgctcctccaccctgtaatcttttcatcacctcccctcctcacacctggtctggcttacagtttccttctgtgactagccctcccccacctgcccagcaatttactcttaaaaaggtggctggagccaaaggcatagtcaagattaatgctcctttttctttatcccaaatcagatagcgtttaggctctttttcatcaaatataaaaatccagcccagttcatggctcatttggcagcaaccctgagacgctttacagccctagaacctaaaaggtcaaaaggtcatcttattctcaatattcattttattacccaatctgctcctgacattaaataaaactccaaaaattggaatctggccctcaaaccccacaacaggacttaattaacctcaccttcaaggtgtacaataacagaaaaaagttgcaattccttgcctccactgcgagacaaaccctagccacatctccagcacacaagaacttccaaacacctgaacagcagcagccaggcgttcctccagaacctcctcccccagaagcttgctacacgtgccagaaatctggctactgggccaaggaatgcccgcagcccgggattcctcctaagccgtatcccatctctgggggaccccactgaaaatcggactgttcaactcacctggcagctactcccagagcccctggaactctggcccaaggatctctgactgactccttcccagatcttctcagcttagcggctgaagactgacactgcccgatcgccttggaagccccctagaccatcacggacgccgagcttcaggtaactctcacagtggaaggtaagcccgtccccttcttaatcaatacggaggccacccactccacattaccttcttttcaagggcctatttcccttgcctgcataactgttgtgggtattgacagccaggcttctaaacctcttaaagctccccaactctggtgccaacttcgacaatactcttttaagcactcctctttagttatccccacctgcccagttcccttattaggctgagacactttaactaaattatctccttccctgactattcctggactacagctatatctcattgccgcccttcttcccaatccaaagcctcctttgcgtcctcctcttttatccccccaccttaacccacaagtataagatacctctactccctccttggcgaccgatcatgcacttcttaccatctcattaaaacctaatcacccttaccccactcaacgccaatatcccatcccgcagcacgctttaaaaagattaaattctgttatcactcgcctgctacagcatggccttttaaagcctataaactctccttacaattctcccattttacctgtcctaaaaccagacaagccttacaagttagttcaggatctgcgccttagcaaccaaattgttttgcctatccaccctgtggtgcccaacccatgcactcttttgtcctcaataccttcctccacaactcactattctgtgcttgatcttaaagatgcttttttcactattcccctgcacccctcatcccagcctctctttgctttcacttagactgaccctgacagccattaggctcagcaaattacctaggctgtactgctgcaaggcttcatagacagcccccattacttcagtcaagcccaaatttcatcctcatctgttacctatctcggcataattctcataaaaacatacgtgctttccctgctgatcgtgtccaattaatctcccaaacctcaatcccttacaaaacaacaactcctttccttcctaggcatagttag

SEQ ID NO: 210 - DNA, 968 bp, Homo sapiens
gtagggaaaagagagattagactgttactgtgtctacgtagaaaaggaagacataagaaactccattttgacctgtaccctgacaattgctttgccctgagatgctgttaatctgtaactttgccccaatcttgagctcacaaaaacatgtgttgtatggaatcaaggtttaagggatctagggctgtgcaggatgtactttgtcaataaaatatttacagggagtatgcttggtaaaagtcatcgccattctccattctcgataaaccaggggcacaatgcactgcggaaagccgcagggacctctggcctagaaagccaggtattgtccaaggtttctccccatgtgatagcctgcgatatggcctggtgggatgggaaagacctgaccatctcccagcccgacatctgtgaagggtctgtgctgaggaggattagtaaaagagaaaggcctcttgcagttgagataagaggaaggcctctgtctcctgcctttccctgggaacggaatgtctcggtataaaacccgattgtacatttggtcaatcctgagatagaaaaaccgccctgtggcgggaggtgacatgttggcagcaatgctgctctgttattctttactccactgagatgtttgggtggagagaagcataaatctggcctgcgtacacatccaggcatagtaccttcccttgaacttattttctcacatgtttccttgctcacatgttttctttcttctccccaccatcaccctgctttcctgctgcattcctcttgctgagatagtgaaaatagtaattaataaatactgagggaactcagagacgagtgccagtgtgggtcctccgtatgctgagcgccgttcccctgagcccactgttctttctctatactttgtctctgtgtcttatttattttctcagtctctcatcccacctgatgagaaatacccataggtgtggaggggc

SEQ ID NO: 211 - DNA, 764 bp, Homo sapiens
gagagacaggactagctggatttcctaggccaactaagaatccctaagcctagctgggaaggtgaccactttcacctttaaacacgggcttggaacttagctcacgcttgaccaatcagatagtaaggagagctcactaaaatgctaattaggcaacaacaggaggtaaagaaatagccaatcatctgttgcctgagagcacagcaggagggacagtgatcggatataaacccaggcattcaagccggcaacgacaaccccctttgggtcccctccctttgtgtgggagctctgttttcactctatttcactctattaaatcttgccgctgcactcttctggtctgtgtttgttacggcttgagctgagctttcgctcaccgtccaccactgctgtttgccgccgtcgcagacccaccgctgacttccattcctccggatccggcagggtgtccgctgtgctcctgatccagagaggcacctactgccacttccaatcgggctaaaggcttgccattgttcctgcacggctaagtgcctgggttcatcctaaccgagctgaatactagtcactgggttccacggttctcttccaggacccacggcttctaatagaggtataacactcaccacatggccgaagattccattcattggaatccatgaggccaagaaccccaggtcagagaacacgaagcttgccgccattttggaagtggctcgccaccatcttgggagctctggaagcaaggacccccagtaaca

SEQ ID NO: 212 - DNA, 787 bp, Homo sapiens
gagagagaggactagttggatttcctaggccgactaagaatccctaagcctagctgggaaggtgaccatccacctttaaacacggggcttgcaacttagctcacacccgaccaatcaggtagtaaagagagctcactaaaatgctaattagacaaaaacaggaggtaaagaaatagccaatcatctatcacctgagagcacagcaggagcaacagtgattgggatataaacccaggcattccagctggcaacggctaccctcttttggacccctccctttgtatgaaagctctgttttcactctattaaatcttgcagctgcacactgttctggtccgtgtttgttatggttccagctgagctttcgctcaccatccaccagtgctgttggccgctgtcgcagaccctccgctgacttccatccctccagatccagcagggtgtcagctgtgctcctgatccagcgaggtgcccattgccaatcctgatccagctaaaggcttgccattgttcctgcacggctaagtggctgggttcgtcttaatcaagccaaacactagtcactgggttccacggttctcttctgtgacccatggcttctaatggagctataacattcactgcatggtccaagattccattccttggaatccctgaagccaagaactccaggtcagagtacacgaggcttgccaccatcttggacgcggcccaccaccatcttggaagtggccctagaacatcttgggagctctgggagcaaggacccccacccctgtaacacttt

SEQ ID NO: 213 - DNA, 67 bp, Homo sapiens
tacaataggtagttagacatgagcagcgcaggagagccccccacctccccaccccaccaggaatgcc

SEQ ID NO: 214 - DNA, 5673 bp, Homo sapiens
gtcaggcctctgagcccaagctaagccatcatatcccctgtgacctgcacgtacacatccagatcgacagttcctgccttaactgataacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccccttttgctttacctacccaaatcctataaaacagctccacccctatctcccttcactgactctctttttggactcagcccacctgcacccaggtgaaataaacagctttattgctcacacaaagcctgttggtggtctcttcacacggacgcacatgaaatttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggtaagcagactcttcttactctcttctccaacctctctcactgtccctcaaccactttctcctttccactcttcaatctcttccttctcttaatttcaattcctttcattttctggtagagacaaaggagacacgttttatccgtggacccaaaactctggcgccagtcatggactagggaaggcagccttcccttggtgtttaatcattggagggacacctctctgattattcgtccaggtttcagaggtgtcagaccacgcagggacgcctgccttggtccttcatccttagtggcaagtcccgcttttctggggaaggggcaagtaccccaaccccttctctctgtgtctctacctcttttccacctttctggggggcaagaaacccccaaccccttttccttcaccctgagcagcaagtcccgcttttctagaggaggggcaagtaccccaacctcatatctctgtgcccccatcccttatttccgtgccccaacctcttatatcgctgtaccccaatccattatttctgtgccctaacctcttatatctctgcaccccaatcccttatttccatgccctgaccttgtatctctgtgccccgacccctttcccgcttttctggagggtaagaacccccaaaccccttccctccatgtctctactctctcttttctctgggtttgtctccttcactatgggcaaccttccaccctccattcctccttcttctcccttagtctgtgttcttaagaacttaaaacctcttcaactctcatctaacctaaaatctaagtgtcttattttcttctgcaatgccgcttgaccccaatacaaactcgacagtagttccaaatagccagaaaacggcactttcaatttttccatccttcaagatctaaataattcttgttgtaaaatgggcaaatggtctgaggtgcctgacatccaggcattcttttacacatcagtccctctatagtctctgttcccaatgcaactcatcccaaatcttcctcctttccctcccacctgtcccctcagtcccaaccccaagcatcactgagtctttctactcttccttttctacagacacatctgacctctcccctcctcgccaggccgagctaggtcccaattcttcctcagcctccggtcctccaccctataatccttttatcatctcccctcctcacacccggtccggcttacagtttcattccgtgactagccctcacctgcccagcaatttactcttaaaaaggtggctgaagctaaaggcatagtcaaggttaatgctcctttttctttatcagacctctcccaaatcagtgagcatttagactctttcatcaaatatgaaaaacccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattctggccctcaaaccccacaacaggatttaatcaacctcgccttcaaggtgtacaataatagaaaaaagttgcaattccttgcctccactgtgagacaaaccccagccacatctccagcacacaagaacttccaaatgcctgaaccacagcgggcaggcgttcctccagaacctcctcccccaggagcttgctacaagtgccagaaatctggccaccaggccaaggaatgcctgcagcccaggattcctcctaagccacgtcccatctgtacggaaccccactggaaatcggactgtccaactcacccggcagccactcccagagcccctggaactctggcccaaggctctcagactccttcccagatcttcttggcttagcggctgaagactgacgctgcccaatcgcctcggaagccccctagaccatcatggatgccgagcttcgggtaactctaacagtgaaggataagtctgtccccatcttaatcaataccaaggctactcactccacattaccttcttttcaagggcctgtttcccttgcctccataactgttgtgggtattgatggccaggcttctaaacctcttaaaagtccccaactctggtgccaaattagacaatactcttttaagcactccttttaattatccccacctgcccagttccctattaggccgagacactttaactaaattatctgcttccctgactattcctggattacagctacatctcattgctgcccttcttcccaatccaaagcctcctttgcgtgctcctcttgtattcccccaccttaacccacaagtataagatacctctactccctccttggcaaccgatcatgcaccccttaccatctcattaaaacctaatcacccttactccaatcaatgccaatatcccatcccacagcatgctttgaaaggattaaagcctgttatcacttgcctgctacagcatggccatttaaagcctataaactctccttacaattcccccattttacctgtcctaaaaccagacaagccttacaagttagttcaggatctgcgccttatcaaccaaattgttttgcctatccaccccgtggttccaaatccatatactctcctatcctcaatacctccctccacaatccattattctgttctggatctcaaacatgctttctttactattcctttccacccttcatcccagcctctcttggctttcacttggactgaccctgacacccactaggctcagcaaattacctaggctgtactgccgcaaggcttcacagacagcccccattacttcagtcaagcccaaatttcatcctcatctgttacctatctcggcataatctcataaaaacacacgtgcgttccctgctgatcgtgtccgattaatctcccaaacctcaatcccttacaaaacaacaactcctttccttcctaggcatggttagtgcggtcagaattcttacacaagagccaggaccgcaccctgtagcctttctgtccaaacaacttgaccttactgttttagcctaggcatcatgtctccgtgcagcggctgctgccaccctaatacttttagaggccgtcaaaatcacaaactatgctcaacttactctctacatttctcataacttccaaaatctattttcttcctcatatctgacgcatatactttctgctccccggctccttcagctgtactcactctttgttaagtcccacaattaccattgttcctggcccggacttcaatccagcctcccacattattcctgataccacacccgacctccatgactgtatctgtctgatcctcctgacattcaccccatttccccatatttccttctttcctgttcctcaccctgatcacgcttgatttattgatggcagttccactaggcctaatcgccacacaccagcaaaggcaggctatgctatagtacaagccactatcccgcctctttgaacctctcatttcctttccatcgtggaaatctatcctcaaggaaataacttctcagtgttccatctactattctaccactcctcagggattattcaggccccctcccttccctacacatcaagcttgaggatttggccccacccaggactggcaaattagctttactcaacatgcccggagtcagataactaaaatacctgttagtctaggtagacactttcactggataggtagagtcctttcctacagggtctgagaaggccaccacagtcattttttcccttctgtcagacataattcctcagtttagccttcctacctcaatacagtctgataacagacaagcttttattagtcaaatcagccaagcagtttttcaggctcctagtattcagtgaaacctttatatcccttacggtcctccatcttcaggaaaagtagaacagactaaaggtcttttaaaaacacacctcaccaagctcagccaccaacttaaaaaggactggataatacttttatgactttcccttctcagaagtcagacctgtcctcagaatactacaaggtacagcccatttgagctcctgtatagacgttcctttttattaggccccagtctcattccagacaccagaacttagactgtgccccccaaaaacttgtcatccctactatcttctgtctagtcatactcctattcaccgttctcaactactcatacatgccctgctattgtttacactgccggtttacagtttctccaagccatcacagctgatatctcctggtgccatccccaaactgccactcttaactcttgaagtaaataaataatctttgctggcaggactatgctgatctccttaggcactctctaagcagatgtcctgagtcatcccaattcttagaccttttatacctgtttttctccttctcttattccgtttagtttttcaattcatacaaaactgttatccaggccatcaccaatacttctaaattacaactattccttctaacaaccccacaatatcaccccttaccacaaaatcttccttcagcttaatctctcccactctaggttcccacgcccccccaatcccactcaaagcagccctgagaaacatcgcccattatctctccataccatcccccaaaatttttgctgtcccaagactttaccactatttcattttatttttcttattaatataagaagacaggaatgtcaggcctctgagcccaagctaagccatcatatcccgtgacctgcacgtacacatccagatcgcgggttcctgccttaactgataacattccaccataaaagaagtgaaaatggcctgttcctgccttaactgatgacattgttttgtgaaattccttctcctggctcatcctggctcaaaagcgcccccactgagtacctgtgccccccactcctgcctgccagagaacaacccccctttttcctttacctacccaaatcctataaaacggccccacccctatctcccttcactgactctctttttggactcagcccacctgcacccaggtgaaataaacagctttattgctcacacaaagcctgtttggtggtctcttcacacggacgcgcatgaaa

SEQ ID NO: 215 - DNA, 676 bp, Homo sapiens
caacagcaacaaccttttcatgagttaaaataaaaactcatgtcggccccagccatggggctacctgacttgacaaaaccctttacactctatgtgtcagaaagagaaaaaatggcagttggagttttcacccagactgtggggccctggccaaggccagtggcctatctctcaaaataactagatggggtttccaaaggctggctcccatgtctaagtgccccggcagcaacggccctgttagcacaagaagtagataaactaacccttgggcaaaacctgaatataaaggcccccccatgctctggtaactttgatgaatatcaaaggaccccccatgctgtggtaactttgatgaataccaaaggacatcattggctaacaaatgctagattaaccaagtaccaaagcttgctatgtgaaaatccccgcataaccattgaagtttgcaacaccctaaaccatgccaccttgcccccagtatcagagagcccagttaaacataactgtgtaaaggtattggactcagtttattctagtgggcccaacctctgagaccatccttgaacatcaatagacttgtgagctgtacgtggatgggagcagctttgccaacccctgcaaagtgactctgaagaagatgacaagtcttgctccagtcactcccggaagctga

SEQ ID NO: 216 - DNA, 748 bp, Homo sapiens
gagagacaagactagctggatttcctaggccaactaagaatccctaagcctagctgggaaagtgatcacttccacctttaaacatggggcttgcaacttagctcacacccgaccaatcagatagtaaagagagctcactaaaatgctaattaggcaaaaacaggggtaaagaaatagccaatcatctattgcctgagagcacagctggagggacaactatcaggatataaacccaggcattcgagctggcaatggctaccctctttgggtcccctccctttgtacgggggctctgttttcactctattaaatcttgcaaccgcactctcttctggtccatgtttgttacagctcgagctgagctttcgcttgccgtccaccactgctgtttgccgccgtcgcagacctgccactgacttccatccctctggatctggcagggtgtctgctgtgctcctgatccagcaaggcgcccattgccactcccgatcggactaaaggcttgccattgttcctgcatggctaagtgcccaggttcgtcctaatcgagctgaacgctagtcactgggttccacagttctcttccgtgacccacagcttctaatagagctataacactcaccacatgtcccaagattccattccttggaatccatgaggccaagaaccccaggtcagagaacccaaggcttgctaccatcttggaaatggcctgccaccatcttgggagctctgggagcaaggaccc

SEQ ID NO: 217 - DNA, 10188 bp, Homo sapiens
aggaggactccttcaggagactgatcccctgtcctgatctccatgaggagctccagctacgacctcaggtcctcagaccaaccagcccaaggaacgtctcaccaatttcaaattgggtaagtggtctttttactgtcttctccaactttgtcactatccctcatcatctttctcctttcaatttcagcaccacctttcaatctctcccttcccttaatttcagttcctttccttttctggtagagacagaggagacatgttttatccatgaacccaaaactccagcgctggtcacggacttgggaagacagtcttcccttggtgtttaatcactgcagggatgcctgtctgattattcacccacatttcagacttgttcaatcaccacagggacacctgccttgatcctccaccttggtggcaagtaccatttcctctttgtggcaagtaccaccccactctctctgtgtctctacccctcttttctctaaacttacgtttttactatgggcaaccatccaccctccattcctcctacttcccccttagcctgtgttcttaaaaacttgaaacctcttcaactctcacctgatctaaaacctaagcatcttattttctcctgcaacactgtttggccccaatacaaacttgataatggctctaaatggccagataatggcacttttgatttctccatcctacaagacctaaataatttttgtcataagatgggtaaatggtctgaggtgccttatgtccaggcattttttcacttcacttcctccctagcttctggtcccaatgtgactagtcccaaatgcttctttccctcctgcctgtcccttcagtcccaacaccaactgctgctgagtcttctgaatcctccttttctgaagacccctcttacctctctccccctccccaggccactcctcagaaggctgaatcaagtcccaattcttcctcagcctccactcccccaccctgtaaccctgctgtcacctcccctccccacacccagttcggcttacaatttcgttctgcagcaaatactccccaacctgcccaacaatttcctctttgagaagtgcctggagctgagggcatcggcagagtgcatgtaccattttctctatcagacctttcccaaattaatcaacacttaggccccttctcgtgagacaccactaaatatatacaggaattccagtatttaatccaatactacaacttaacctggagtgacttaaatgtcatcctaccttctaccctttccccagatgagtgggatagagtttataccctagcccagtcccacactgacacctgcaggcctcatgagccaaaccttcaacaaggcatctgggtagttccccaagaagatccctaatgggaataccagacaggctccccaggtatagctaggcaagattatgatttcctgcctagttgaagtgcttaaaaaggcagcttacaaagctgttaattatgacaaacttaaacgacccaaggtaaagatgaaaacccagcccagttcatggttcatctggcagcaattctgagacactttacagccctagaccctgaagggtcagaaggctgtctcattctcaatatgcattttatcaaccagtcagctcctgacattagaaaaaagcttcaaaaattggaatccagtcctcaaaccccacaacaggaattaatcaacctcaccttcaaagtgtgcaataatagagaggaggcagccaaatggcaatgcatttctgagttacaattacttgcctctgctgtgagacaaaactcagctgcagctccagcacacaagaacttcaaaacgcctaagctgcagtggtcaggcattcctacaggacctcctctctcaggatcttgcttcaagtgccagaaatctggccactgggccaaggaatgcctgcagccagggattcctcccaagccacgtcccatctgtgcagggacccatggaaatcagactgtccagctcacccagaagccactcctagagcccctaaagctctggcccatggctctttgactccttcccagatctgctcggcttagcagctgaagactgtcactgcccaattgcctcggaagccctctggaccatcagggatgctgagctttgggtaactcttacagtggggcgtaagtccatcccctgtttaattgatacaggggctaaccactccacattaccttcttttcaagggcctgtttcccttgcctccataactgttgtgggtattgatggccaggctcctggaccccttaaaacttcccaatttggtgccaacttgaacaatattcttttatgcactcctttttagttatccccacctgcccagttcccttattaggctgagacattttaaccaaattacctgcttccctgactattcctggactacagccacatctcattgccgcccttcttcccaacccaaagcctccttcacgtcttcctcttgtatccccccaccttaacccacaggtatgggacacctctgctccctccctggcaactgatcacacacccatacctaatcacccttaccctgctcaacaccagtatcccatcccacaacaggctttaaggggattaaagcctgttatcactcgcctgctacagcatgagcttctaaagtctaaaaactccttatgattcccccattttaagtgtccaaaagctggacgagtcttacaggttggttcaggatctgtgccttttaaaccaaattgttttgcctatccaccctgtggtgcccaacctgtacactcttttgttctcaatactgccctccacaactcactattccattcttgatcttaaacatgcttttttcactattcccctgcacccctcatcccagcccctctttgcttttacctggactgacactgacactcatcagtcccagcagcttacctgggctgtactgccgcaaggcttccgggatagccctcattacttcagccaagctctttctcatgatttactttcttttcactcctctgcttcctaccttattcaatacattgatgaccttctactctgtagtccctactttgagtctttgcaaaaggatatcctcctactccttcaacatttattctccaaaggatatcaggtatcccccaccaaagctcaaatttcttccccatccattacctaccttggcataattcttcatgaaaacatgcatgctatccctgccaactgtgtccagctgatctctcaaaccccaaccccttctataaaacaacaactcctttccttcctgggcatggttggatactttcacctttggacacctggctttgctgtcctaacaaaaccattgtatcaactcacaaagggaaacctagctgaccgcacagatcctaaatcctttccccactcgtctttccgttccttgaagacagctctggagactgctcccacactagctctccctgactcatcccaacccttttcactacacacagccgaagtgcagggttgtgcagtcggaattcttacacaaggaccaggactgcaccctgtagcctttttgtccaaacaacttgaccttcctattatacgctggccatgatgtctccgtgcagctaccaccaccctaatacttttagaggccctcaaagtcacaaactatgctcaactcactctccacatttctcataacttcccaaatctattttcttcctcacacctgatgcatatactttttgctccctggctccttcagctatactcactctttgttgagtctcccacaattaccattgttcctggcccagacatcaatccagcctgccacattattccagataccacacctgacccccatgactgtatctctctgatccccctgacattcactccatttccccctcctttcgtgttcctcatcctgatcacatttggtttattgatggcagttccaccaggcctaatcgccactcaccagcaaaggcaggctatgctatagtatcttccacatctatcattgaggctaccactctgccccactcccacagcctctcagcaagcagaactcattgcctaaactcaggccctcactcttgcaaagggactacacatcaatatttatactgactcaaaatataccttccatatcttgcaccaccatgctgttatatgggctgaaagaggtttcccccctatgcaagtgtcctccatcattaatgcctccttaataaaaactcttctcaaggccgcattctccttatgtcaagtctactccccccatatttggactccccacaacacaagctactatttctgtggtcactccattatgtatctctcagcaaagacccactggaattcccctggggaacttttcaccttctcaatgctccttcactcttcatctccaaagcccaactacatatatcacagaaacaattggggccttccagctccgtattacagacaagacatctatcaatactggcaaacttaaaaacattattgcttaggaaaacatttaccctgtatttcactccatccttggctaccttccccttgctcttcagactctcctcccaggccctcttcttatttacttatatccagccccataaataacagtgaaagtttgcttgtagacactcaatgctttctcatacaccatgaatattgaacctccccctctacacagttaccccatcagtccccattacaacctctgatggctgccgccctagctggatccctgagtctgggtaaaagacacctcttttagcacttcttctcatcttttcactttgcatttccaattttgccttgcaaaaggcctcttcttctgtggctcctccgcttacatgtgtctgcctgctaatcggacagggacatgtacactcatttttctcattcccaaaattcaatttgcaaatgggactgaacaacttcctatcccactcatgataccaaacagacaaaaaagagttattcctctaatccctctacttatagggttaggactttctgcttccactattgcccttggagctggaatagcaggcatttcaacttctgtcacgaccttccatagcctttcaaatgacatttctactagcattacagatatatcacaaactttatcagtccttcaggccaagtcaactcttagccccagttgtcctccaaaattgctgaggcctggacttactcactgctgaaaaaggaggactctgtatatttttaaatgaagagtattgtttttacgtaaatcagtctggcctggtatatgacaacataaactcaaggatagagcccagaaatttgccaaccaggcaaatcattacacaggacccatctggacactttctaactgagtgtcttggctactccctattcttagtcccctggtacctgtttttctccttctcttattcaggccctgtgtcttccatttagtttctcaattcatacaaaaccacattcagaccatcaccaatcattctatatgacaaatgctacttttaacaaccccacagtaccatcccccgcaccaagatctccccacagcctaaatccctattccttgtaactcattataaaattttccttaaggtgtccacgcagctcctaatctcactcgaagcaaccctgagaaacatcatccattatctctccataccacccccaaaaatttttgccaccccaacacttcactattttgttttatttttcttattaatataagaagacaggaatgtcaggcctctgagcccaagactgcaggtatacatccagatggcctgaggcaaccgaaaagtacaaaagaagtgaaacagccagcccctgtcttaactgattgaccaaccttatgactttccattatgacttgttcctgccctgccccaactgatcgatcgaccttgagaaattcttctggacaatgagtcttatgatctccccacaatgcaccttgtgacgctctcctctgctgacaatagataaccacctttaactgtaactatccactgcttaccccaggcctataaaactgccccaccccatctccttttgctgacttctttttcagacccagtctgcctgcacccaggtgaaataaacagccttgttgctcacacaaagcctatttggtggtctcttcacacagacgagcatgacactgcagtctagttgagggtggagggtgggaggaaggagaggcataaaaaagaaaaactattgggggccaggtgttgtggttcatgcctgtaattccagcactttgggaggccgaggtgggtggatcacctgaggtcaggaattcaagaccagcctggccaatgtggtgaaaccctctctctactaaaaatacaaaaattagccaggcatgatggcaggcacctgtaatcccagctactgaggcaggagaatcccttgaacctgggaggcagaaattgcaatgagctgagatcataccagtactctggcctgagcaaaagagcaaaactcagtctcaactaaataaataaataaatattgggtactgggcttaatgtcaaggtgatgaactactctgtacaacaaaccccgatgacacgagtttacctgtgtaacaaaccttcacatgtagccccaaacctaaagtaaaaaaatgaatattgtcaggcctctgagcccaagctaagccatcatatcccgtgacctgcacgtacacatccagatggccagttccttccttaactgatgacattccaccacaaaagaagtgaaaatggcctgttcctgccttaactgatgacactgtcttttgaaattccttctcctggctcatcctggctcaaaagctcccccactgagtacgttgtgacacccactcctgcccaccagagaacaacccccctttttcctttacctacccaaatcctataaaatggcccaacccctatctatctccctttactctctttttggactcagcccacctgcacccaggtgaaataaagttttattgctcacacaaagcctgtttggtggtctcttcacacggacacgcatgaaatttggtgccatgactcagattgggggacctcccttgggagatcaatcgctgtcctcctgctctttgctccatgaggaagatccacctacgacctcaggtcctcagactgaccagcccaagaaacatctcaccaatttcaaatccggtaagtggcctctttttactctcttctccaacctccctcactatccctcaacctctgtctcctttcaatcttggcaccacacttcaatctctcctttctcttaatttcaattcctttcattttctggtagagacaaaggagacacgttttatccgtggacccaaaactcgggcgccggtcacggagtagggaaggcagccttcccttggtgtttaatcattgcagggacgcctctctgattattcacccaggtttcagaggtgtcagaccacacagggacgcctgccttggtccttcacccttagcagcaagttccgcttttctagggaaggtgtaagtaccccaacaccttctctctgtgtctctaccccttcttcgcctttctggggggcaagaaaccccaaccccttctccttcacccttagcagcaagtcccacttttctaggggaggagcaagtaccccaaccccttatatctctgcaccccaatcccttatttccatgccccaacctcatatatctctgtgccccaacctcttatatctctgtgccccaatcccttatttccatgccctgacctcatatctctgtgccccaaccgctttcccacttttctggaggtaagaacccccaaaccccttccctccgtgtctctactctcttttctctgggcttgcctccttcactataggcaatattccaccctccattcctccttctccctttcctgtgttcttaagaacttaaaacctcttcaactctcacctgacctaaaatctaagcatcttattttcttctgcaatgccgctggaccccaatacaaactcgacagtagttccaaatagccagaaaacagcactttcaatttttccaccctgcaagatctaaataattcttgtcataaaataagcaaacggtctgaggtgcctgacatccaggcattcttttacacatcggtccctgtgcccagtctctgtgcccagtgcaactcatcccaaatcttccttctttccctcctgcctgttccctcagtcccaaccccaagcatcgctgagtctttctaatcttccttttctacaggcccatctgaactcttcccctcctccccaggctgctccttgccaggccgagctaggtcccaattcttcctcagcctccgctcctccaccctgtaatctttttatcacctcacctgctcacacccggtccggcttacagttttgttccgtgactagccctcccccacctgcccagcaatttactcttaaaaaggtggctggagctaaaggcatagtcaaggttaatgctcctttttctttattccaaatcagataacgtttaggctctttttcatcaaatataaaaatccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaacgcctgaaccacagtggccaggcattcctccagaacctcctcccccaggagcttgctacaagtgccagaaatctggccactgggccaaggaatgcccgcagcccaggattcctcctaagccgtgtcccatctgtgtgggaccccactgaaaatcggaccgttcaactcacttggcaaccactcccagagcccctggaacgctggcccatggctctctgactgactccttcccagatcttcttggcttagtggctgaagactgacactgcccgatcgcctcggaagcctacaggaccatcacagatgctctaagtaactctcacagtggaaagtcagtctgtccccttcttaatcaatacggaggctacccactccacattaccttcttttcaagggcctgtttctcttgcctccataactgttgtgggtattgacagccaggcttctaagcctcttaaaactcccccactctggtgccaacttggacaacactcttttatgcactcttttttagttatccccacctgcccagttcccttgttaggctgagatattttaaccaaattatctgcttccctgactattcctggactacagccgcatctcactgctgcccttctccccaacccaaagcttccttcgcatcctcctctcgtatccccccaccttaacccacaagtatgggacatctccactccttccctggcaactgctcacatgcccgttaccatcccattaaaacctaatcacccttaccccactcaacgccagtatcccatcccacagcacgctttaaaaatattaaagcctgttatcactcgcctgttacagcatggccttttaaagcctataaactctccttacaactcccccattttacctgtcctaaaaccagataagacttaataggttagttcaggatctgcaccttatcaaccaaattgttttgcctatccaccccatggtgccaaacccatatactctcctatcctcagtacctgcctctactacccattattctgttctggatctcacacatgctttctttactattcctttgcacccttcatcccagcctctcttcgctttcacttggactgaccctgacacccattaggctcagcaaattacctggggctgtactgccgcaaggcttcacagacagcccccattacttcagtcaagcccaaatttcttcctcatctgttacctatctcagcataattctcataaaaacacatgtgctctccctgctgatcgtgtccaattaatctcccaaacctcaatcccttacaaaacaacaactcctttccttcctaggcatagttag

SEQ ID NO: 218 - DNA, 998 bp, Homo sapiens
atggggaaaagaaagagagatcagactgttactgtgtctatgtagaaaaaggaagacataagaaactccattttgatctgtactaagaaaaattcttctgctttgaaatgctattaatctgtaaccctagccccaaccctgtgctcacagaaacatgcgctgtattgactcaaggttaatggatttagggctgtgcaggatgtgctttgttaacaatgtgtttgaaggcagtatgcttggtaaaggtcatcgccattctccagtcttgagtacccagggacacaatgcactgtggaaagccatggggacctctgcccaagaaagcctgggtgttgtccaggcttccccacactgagacagcctgagatgtggcctcgttggaagggaaagaccttacattatagtcccccagccggacacccataaaaggtctgtgctgaggaggattactgaaagaggaaggcctctttgcagttaagaggaaagcatctgtctcatgatcccctgggaatggaatgtcttggtgtaaaacctgatcgtacattctatttactgagataggagaaaaccgccctatggctggaggtgagacatgctggtggcaatactgatctttactgcacggcaatactgatctttactgcactgagatgtttatgtaaagttaaacataaatctagcctacgtgcacattcaggcatagcacctttccttaaacttatttatgacacagagtcttttgttcacatgttttcctgttgaccctctctccaccattaccctatagtcctgccacatccccctcactgagatagtagagataatgatcaataaatactgagggaattcagaaaccagtgccggtgcaggtcctcacttgctgagtgccggtcccctgggcccacttttcttcctctatgctttacctctgtgtcttatttcttttctcagtctctcgtctccaccttgcgagaaatacccacaggtgtggaggggca

SEQ ID NO: 219 - DNA, 382 bp, Homo sapiens
gccaggcctctgagcccaagctaagccatcataacccctgtgacctgcacatatacatccagatggcctgaagcaactgaagaatcacaaaagaagtgaaaatggcctgttcctgccttaactgatgacattaccttgtgaaattccttctcctggctcagaagctcccgactgagcaccttgtgaccctcgcccctgcctcccagagaacccctttgactttaattttccataacctacccaaatcctataaaactgccccacccatatctctcttcgctgactctcttttcggactcagcccgcctgcactgaggtgattaaaaagctttattgctcacacaaagcctgtttggtggtctcttcacacggacacgcatga

SEQ ID NO: 220 - DNA, 649 bp, Homo sapiens
ttagagtgggtagctagggagacatgaacaggacaggagaagccccactataccccaggaatgtcaggcgaccatcaggggatagttaagttgttgttaaactgtctctaattggccatacctggcaccaggaaagggcaggctcttaatagatagaaaatacctgaagctggtgatctgcagcttccgaataagatctctggagttgggcaagtggactcaagcatgtgcactaggagggaagatggcagagtttaactggcatatggccttcctccaagaccactggtaagggaaaaatgcttcaaatgagcatgcacacaacttcagtaaacacactgtgcatgtggcccctcccaagtgctggcaggtcactgtgcatgtggacacgctaccccaagggaaaaatcaagggaggagaaacagaagccccagaaccatgccaatgtataaaaccctaaaccaagggccaaacagtgcacttgtatctctcaagttgcccacttgcccctgttccaagtgtactttacttccttttgttcctgttctacaacttgccttagtctctcactctgtctaatgccccttagccgaattctttcctctgaggaggcaaaaatggagttgctgcagacttatatggatttgc

SEQ ID NO: 221 - DNA, 5806 bp, Homo sapiens
gtcaggcctctgagcccaagccaagccatcgcatcccctgtgatttgcacatgtacgcccagatgacctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactgctgcctgccagagaacaacccccctttgactaattttcctttacctacccagatcctataaaatggccccacccctatctcccttcaccgactctcttttcggactcagtccgcctgcacccgggtgaaataaacagccatgttgctcacacaaagcctgtttggtggtctcttcacacggacgtgcatgaaatttggtgccgtgactcggatcgggggacctcccttgggagatcaatcccctgtcctcctgttctttgctccacgagaaagatccacctacgacctcaggtcctcagactgaccagcccaaggaacatctcaccaattttaaatcaggtaagcggcctcttcttactctcttctccaacctctctcactgtccctcaaccactttcttctttccactcttcaatctctcccttctcttaatttcaattcctttcattttctgggagagacaaaggagacatgtttttatccgtggacccaaaactccggcgctggtcacggactgggaaggcagccttcccctggtgttttatcattgcagggacgcctctctgattattcacccacgtttcaaaggtgtcagaccacgcagggacgcctgccttggtccttcacccttagcagcaagtcccacttttctgggaaaggggcaagtacctcaaccccttctctccttgtctctaccccttctctgcttttctgggggaggggcaagtacccctcaaccccttctccttcactcttagcggcaagtcccgcttttctagaggatgggcaagtaccccaacctcgtatctctgtgccccaatcccttatttccgcgccccaacctcttatatctctgtgccccaatcccttatttccatgctcgaccccttatttccgtgcccctaccccttatttctgtgcttcatcccttatttccatgccccgacctcttatctctgcgccccaacctcttttcccacttttctggaaggtaagaacccccgaaccccttccctcagtttctctactctctcttttctctaggcttgcttccttcactataggcaaccttccacccttcattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaagtaattcttgtcgtaaaatagccaaatggtctgaggtgcctgacgtccaggcattcttttacacatcagtcccttcctagtctctgtgcccagtgccactcatcccaaatcttccttctttccctcccgcctgtcccctcagtaccaaccccaagcatcgctgagtctttctaatcttccttttctacagatccatctgacctctcccttcctccccaggctgctcctcgccaggccgagctaggtcccaattcttcctcagcctctgctcctccaccctataatcttttcatcacctcccctcctcacacctggtctggcttacagtttcgttccatgactagccctccccctcctgcccagcaatttactcttaaaaaggtggctggagccaaaggcatagtcaactttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctccagacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacacaggaacttccaaatgcctgaaccgcagcggccaggctcctccagaacctcctcccacaggagcttgctacatgtgccagaaatctggccactgggccaaggaatgcctgcagcccgggattcctcctaagccgtgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagaccatcacagacgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattgtctgcttccctgactattcctggactacagctatatctcattgccgcccttcttcccaatccaaagcctcctttgcgtcctcctcttgtatccccccaccttaacccacaagtataagatacctctactccctccttggcgaccaatcatgcacccgttaccatctcattaaaacctaatcacccttaccccactcaacgccaatatcccatcccgcagcatgctttaaaaagattaaagcctgttatcacttgcctgctacagcatggccttttaaagcctataaactctccttacaattcccccattttacctgtcctaaaaccggacgagccttacaagttagttcaggatctgcgccttatcaaccaaattgttttgcctatccaccccgtagtgccaaacccatatactctcctatcctcagtacctgcctctataacctattattctgttctagatctcaaacatgctttctttactattcctttgcacccttaatcccagcctctcttcactttcacttggactgaccctgacacccatcaagctcagcaagttacctaggctgtactgccgcaaagcttcacagacagcccctattacttcaatcaagcccaaatttcttcctcatctgttacctatctcagcataattctcataaaaacacacgtgctctccctgccaatcatgtccgactaatctctcaaacccaagcaccttctacaaaacaacaactcctttccttcctaggcatggttagcgtggtcagaattcttacacaagagccaggaccgcaccctgtagcctttctgtccaaacaacttgaccttactgttttagcctagccctcatgtctgcgtgcagcggctcccgctgctttaatacttttagaggccctcaaaatcacaaactatgctcaactcactctctacagttctcataacttccaaaatctattttcttcctcatacctgacgcacatactttctgctccccggctccttcagctgtacccactctttgttgagtctcccacaattaccgttgttcctggcccagacttcaatccggcctcccacgttattcctgataccacacctgacccccatgactgtatctctctgatccatctgacattcaccccatttccccaaatttccttctttcctcttcctcaccctgatcacgcttgatttattgttggcggttccaccaggcctaatcaccacacaccagcaaaggcaggttatgctatagtacaagccactagcctgcctcttagaacctctcatttcctttccatcgtggaaatcgatcctcaaggaaataacttctcagtgttccatctgctattctagtactcctcagggattattcaggcccccttccttccctacacaccaagctcaaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagacaagcatttattagtcaaatcagccaagcagtttttcaggctcttagtattcagtgaaacctttatgtcccttatggtcctctgtcttcaagaaaagtagaatggactaaaggtcttttaaaaacacactcagccaccaacttaaaaaggactggacaatacttttaccactttcccttctcagaattcaggcctgtcctcggaatgctgcagggtacagcgcatttgagctcctgtatagacactcctttttattaggccccagtctcattccagacaccagaccaacttacactgtgccgcaaaaaacttgtcatccctactatcttctgtctagtcatactcctattcaccattctcaactactcatacatgccctgctcttgtttacactgccggtttacactgtttttccatgccatcacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttcctttattccatttagtttctcaattcatccaaatccatatctaggccatcaccaatcattctatatgacaaatgtttcttctaacatccccacaatatcaccccttaccacaaggcctcccttcagcttaatctctcccactctaggttcccacgtcacccctaatcccgcttgaagcagccctgagaaacatcgcccattctctctccataccaccacccaaaaatttttgccgccccaacacttcaacactattttgttttatttttcttattaatgtaagaaggcaggaatgtcaggcctctgagcccaagccaagccatggcatcccctgtgatttgcacatgtacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactgctgcctgccagagaacaacccccctttgactgtaattttcctttacctacccaaatcctataaaacggccccacccctatctcccttcactgactctcttttcggactcagtccgcctgcacccgggtgaaataaacagccatgttgctcacacaaagcctgtttggtggtctgttcacacggacgtgcatgaaa

SEQ ID NO: 222 - DNA, 960 bp, Homo sapiens
gtggggaaaagcaagagagatcagattgttactgtgtctgtatagaaagaagtagacataggagactccattttattctgtactaagaaaaattcttctgccttgagattctgttaatctatgaccctacccccaacccggtgctctctgaaacatgtgctgtgtcaaactcagggttaaatggattaagggttgtgcaagatgtgctttgttaaacagatgcttgaaggcagcttgctccttaagagtcatcaccactccctaatctcaagtacccagggacacaaacactgcggaaggacccctgcctaggaaagccaggtattgtccaaggtttctccccatgtgatagtctgaaatatggccttgtgggaagggaaagacctgaccgtcccccagcccgacacccgtaaagggtctgtgctgaggaggattagtataagaggaaggcaagcctcttgcagttgagacaagaggaaggcatctgtctcctgcccgtccctgggcaatggaatgtctcagtataaaacccgattgtaggttccatctactgagatagggaaaaaccgccttagggctggaggtgggacgtgcgggcagcaatactgctttgtaaagcattgagatgtttctgtgtatgcatatctaaaagcacagtacttaatcctttaccttgtctatgttgcaaagacctttgttcacgtgtttgtctgctgaccctctccccactattgtcttgtgaccctgacacatccccctctcggagaaacacccatgaatgatcaataaatactaagggaactcagaggctggcgggatcctccatatgctgaacgctggttccctgggtccccttatttctttctctatactttgtatctgtgtctttttcttttccaagtctctcgttccaccttacgagaaacacccacaggtgtggaggggcaacccaccccttca

SEQ ID NO: 223 - DNA, 976 bp, Homo sapiens
gtgggggaaagagaaatcagactgttactgtgtctctgtagaaaaaggaagacataagagactccattttgatctgtactaagaaaaattcttctgctttgagatgctgttaatctgtaaccctagccccaaccctgtgcttgcagaaacatgtactgtattgactcagggtttaatggatttagggctgtgcaggatgtgttttgttaaaaatgtgtttgcaggcagtatgtttggtaaaagtcattgccattctccagtcttgagtacccagggacacaatgcactgtggaaagcttcagggacctctgcccaagaaagtctgggtattgtccaaggtctccccgcactgagacagcctgagatatggcctcatggaaagggaaagacctgaccaaccccagtctgacacctgtaaagggtctgtgctgaggaggactagtgaaagaggaaggactctttgcagttgagataagaggaaggcatctgtctcctgctcatccctgggattggaatgtcgtggtgtaaaacccgattggacattctatttactgagataggagaaaaccaccttatggctggaggtgagacatgctggcgacaatactgctctttactgcattgagatgttcgtgtaaagtcaaacataaatctggcctacatgcacatcgaggcacggcaactttccttaaacttttttatgacacagagtcctttgctcacatgttttcctgctgaccctctccccaccattaccctatagtcctgccacatccccctcaccgagatggtagacagtgatcaataaatactgaaggaactcagagaccagtgctggtgcgggtcctccgtatgctgagtgctgcctgggcccacttttcttcctctgtactttgtctctgtgtcttatttcttttctcagtctctcatctccacctttcgagaaatacccacaggtgtggaggggcaggccccc

SEQ ID NO: 224 - DNA, 359 bp, Homo sapiens
gtcaggcctctgagcccaagcctgcacatccagatggcctgaagcaagtgaagaatcacaaaataagtgaaaatggccggttcctgctttaactgatgacattaccttgtgaaattccttctcctggctcagaagctccccaactgagcatcttgtgacccctgcccctgcctgccaaagaacaaccccctttgactgcaattttccactacctacccaaatcctataaaacagccccacccctatctccctttgctgactctcttttcagactcagcccgcctgcacccaggttaaataaacagccttgttgctcacacgaagcctgttaggtggtctcttcacttggacacgtgtga

SEQ ID NO: 225 - DNA, 4131 bp, Homo sapiens
cctttgctgactccttttttggactcagcccgcctacacccaggtaaaataaacagccttgttgctcacacaaagcctgtttggtggtctcttcatagggacgcatgagacatttggtgccgaagacctgggtcagcgggactcctttgggagaccagtcccccatcctcaccctcactctgtgaagagatccacctacgaccttgggtcctcagaccaaccagcctaaggaacatctcacctattttaaatcgggtaagcggcctctttctactctcttctccaacctctctcactatccctcaacctcttttcctttcaatcttggcaccacccttcagtctctcccttctcttaatttcaattcctttcattttctggtagagacaaaggagacacattttatctgtggacccaaaactccggcacaggtcacagactcaggaacacagccttcccttggtgtttaatcattgtggggatgcctgcctgattattcacccacattccgttggtgtctgatctccgtggggatgcctaacttggtcattcacccacattcccttggtggcaagttaattgtagggacaattgctttggctgctcacccacattgcagcccagggctgctcatgtcaccccttctctccgtgtctctaccctctcttttctctccactttcctggggggcaagcaccccccaccccttctctctgtgtctctgccccttttccactttcctggggggcaagaacctcccaccccttctctccgtgtctctgccccttttccattttcctaggggggcaagtaccccccaccccttctctccatgtctctgccccttttccactttcctggggggcaagcacctcccaccccttttccactttcctggggggcaagcacctcccaccccatttccactttcctgcgggggcaagcaccttcttttcaagggcctgtttcccttgcctccataactgttgtgagtattgacagccaggcttctaaacctcttaaaactccccaactctggtgccaacttggacaacattctttaatgaactcctttttagttatcccacctgcccagctcgcttattagttcaaaacattgtaactaaattatctgcttccctgactattcctgggttaaagccacacctcactactgccttttgccccagttcaatgcctcctgcacatcctctccttgtatctccccaccttaatccacaagtgtaggacacctctactccctccttggcgatggatgatgcaccccttaccatcctattaaaatctaatcacccttaccctgctcagtgccaatatcccatcccacagcacgctttaaaaggattaaagcctgttatcacttgcctgttacagcatggccttttaaagcctataaactctccttacaattcccccattttacctgtccaaaaactggacaagtctcacaggttagttcaggatctgcgtttatcaaccaaattgtcttgcctatccaccccatggtgccaaagccatatactctcctatcctcagtacctccctccacaacccctccataacccattattctgttctggatctcaaacatgctttctttactattccttgcacccttcatcccagcctctctttgctttcacttggactgaccctgacacccatcaggctcagcaaattacctgggctgtactgccacaaggcttcacggacagcccccattacttcagtcaagcccaaatttcttcctcatccattacctatctcgacatagttcttcatgaaaacacacgtgctctccctgctgattgtgtctggctaatctcccaaaccccaaccccttctacaaaacaacaactcctttccttcctaggcatggttggatactttcacctttagatacctggttttgccatcctaataaaaccattatataaactcacaaaaccaaacctagctgaccccatagatcctaaatcctttcaccactcctctttctgttccttaaaaacagccctagaagctgcccccacactagctctccctaactcatcccaacccttttcattacacacagccaaagtacagggctgtgcagtcaaaattcttacacaagagctgggactgcaccctgtagcctttctgtccaaacaacttgaccttactctttttggctggcccccacccccatgactgtatctctctgatccacctgacattcactccatttccccgtatttccttctttcatgttcctcaccctgatcacacttggtttattgatggcagttccaccaggcctaaccgccactcaccagcaaaggcaggctatgctatagtatcttccatatctatcactgaggctaccactctgccctcctccactacctctcagcaagccaaattcattgccttaactcgaacactcactcttgcaaaggaattatgcatcaatatttatacagactgtaaatatgccttccatatcctgcaccaccatgctgttatatgggctgaaagaggtttcctcactatgcaagggtcctccatcattaatgcctctttaataaaaactcttctcaaggccgctttacttcccaagaaagctggagtcatacactgcaagggccactaaaagacatcagatcccattgctcagggcaacgcttatgctgataaggtagctaaagaagcacctagtgttccaacttctgtccctcatggccagtttttctccttctaattggtcactcctatttactctcctactgaagtttccacctatcaatctcttcccgcacaaggcaaattgttcttggaccaaggaaaatatctccttccagcctcacatgcccattctattctgttgtcatttcataacctcttccacggtaggttacaagccgttagtctgcctcttcaaacctctcatttcctttccatcgtgaatatctatccccagtcctccactcttgactccctcttggagtggatagatgatctttgctgacaggacacattccaacactttcaccctgatgaagtcctattctttacttttatactcactcttattcttgttcccattcttattgccaccctctacctctccccagctatctccaccacactatcaatttcactcactctctcctagctatttctaatccttctttaacaaacaattgctggctttgcatttctctttcctccaaaatcaccaaggcctcaatttactcactgctgaaaagggaggactctgtatatttttaaatgaagagtgttgtttttaccttaatcaatctggcctggtatatgacaacataaaaaaactcaaggatagagccccaaaactcgtcaactaagaatataattatgctgaacccccttgggcactctctaattggatgtcctgggttctcccaattcttagtcctttaatacttgtttttctccttctcttattcagaagttgtgtctgtcatttagtttctcaattcatacaaaaccacattcaggccatcaccaataattctatatgacaaatgctccttctaacaactccacaatatcaccccttaccccaaaatatttcttcagtttaatctctcccactctaggttctcacaccaccccaatcccacttggagcagccctgagaaacattgcccattatctctccataccaccccaaaaatttttgccacaccaacacttcaccactattttgttttgtttttcttattaatacatgaagacaggaatgtcaggcctctgaacccaagctaagccatcatatcccctgtgacctgcatttatacatccagatggcctgaagcaaatgaagatccacaaaagaagtaaaaatagccttaactgatgacattccaccattgtcatctgccctaccctaactgagaagatatattctcccccgcccttaagaaggtactttgtatgcctatcccaaacctataagaactaatgataatcccagcgccctttgatgactcttttttctgactcagcccacctgtacccaggtgaaataaacagccttgttgctcacacaaagcctgtttggtggtctcttcgcaaggacgcatgaga

SEQ ID NO: 226 - DNA, 4890 bp, Homo sapiens
ttagagtaggtagtcaggcagacatgagcagggcaggagagggcccccagctcaggaatgtcaggcgaccatcaggtgatgatcaggcggttgttacactgtttctctaaaataataataatgggttgcagccagtaccagggaaagacagtctcccaaaagacaggaaacaccggaagctggtgatcagcaacttcctgataagatctccgaagctgggcaagtgggctcaagcatgcgcactaagaagcaaaatgacagtttaaccagtatgtgaccttcctctaggaacacctgactgataagggaaaaatgtctcaagaaagcatgcgcacaacttcagtaaacaaatgcacatgtggctcctcccaagtgctgacaggccactgcacagcagacagcccaccccaaggaaaaaaatccaaggaggagaaatggaaaccccggaaccatgccgatgtataaaaccccaagtcaagggctgaacagggcacttggatctctcaaatggtgcagtgactcggataccttccctagtggtaagacacctctacgccttgccttcttcggctggaggcgttcaaccctcgtacgtggtttcgttctcctctttcactctcctgcttactaacctacccctggaacgattcctctcaaccacagtggctctgctccccctggctgctctctctgctcaccccgaaggatggcttgcaggggtgggaaggaccttggagtctgcactaagtagacctgagacactaatggcccccccagacaggaggctgatgagagcggtagggctaaaacctacaaccatgtagtatctggggtttcctctgctttttcaactaaaatcagctctttcccaaaaacccaccaccacctattttcctttctctgtatgtattccaaaatgacctcgcacacccattggaccaactgccttgggggtaagtctgtcttttctctgttcttactttgcatgccctgcaactttcttctctgccttaaacacacattccctatttgttattcatgcacccgcagctcttgctgtgttagcctggcaaccaagagatggactcccttacggatgtcccttgatatttatacttgttaccctaccagctcggatgacctccaaccctttccctgtctgttggctcactgccgggatagacactaatcagaaccttagctctgtcagctccttatgacttaccatatgcttttcatccctgttatgctccagggccatgtttctccctggcttttgaatggtttgcttgcttgcataggacctcactctgtagcccttaaggaccccacccactcgctttttttctgagttagcacccctttgtggggaaggaaaattctctgccgtttgcagggtcttatcccaaacaccaagtcctccagaggttcctcctttatatcaagagggcaaataaacgttgccctctcaaatccaagggctgctgtttctgcaaacatatgaaggctttccatgagtattcctcttgcttcctcccgctttctcctgtagcagagggattgttctacctcgttaagcatttgttctgcatgttaccctgggaggatgaagaatcccaaatacaaattttcctccattcctctaatcacctccaggcccttctcaatatgtatcaggaccttcaaagttatatttgaagggagagaagtccagcccccttgcagcaattggcagaaaaacaggcttctcgtcttcttaaagaacatgggaaatgagaatctgagaagagataatcattctgttgctagaatgctctgaacaagggtcactataaggtcatggagacaaggatataggacagcccaaggaggcagatgcaagagaccaaagtacccatagaacagagatgaagactagttccaggctacaaacacaaaacagattaccactgcaacacagatgaaggctggtccagaaatgggatgggatcagggtaggggtacccagtaaacactgggttcattccagaaccccttggatgagtgggagggcaccctgttcactgtagtctgccataggcacaggattaagagaacaaggggagatgccctcttctcgcctctgttctttctttacaaacgggtaattgtgcctcaataaaacaagatgggaccaaggttaggggtacctggtaagcactggttcattctggaacccctagaatgaatgggggacactgccatacgcaaaggaaaaatggatgaatggggtaatgccctacccactctggtctgctgtaagttcaggaaaaagacagtagggaaattggaggggttgccttctttttctcttctctcctctgttctctctgtggacaggtaatcaagtctctgtaccacaggacacactactaggatacatcctcaagaactgggaaaagtttgactcccaaaccctaaaaaggaaaaggctaatatttttctgtaatacagcctgggttgaataaaagctctaggaccaggaatcttggccagaaaatagaagcacaaatttaaatatgatccatcaactagatttgttttgctaccaccagggaaaatggacagaaatcccctatgtgctggccttcatggccctaagaaacaaccctgacctttgttgggcttgtaaaacagatccatggccatagtcatgcagccccttcccattggttcagaaggcccctcatcaggtttacccagagctcaagccccattgccccttctacccaattatatcgaagtctcccagaagccttctcctccctacccagggccatcctctggacaccacctccttaagttatgccccattcaggaggtttagtggtcccagtggacccactggagtccagactccattcactgtgcaagacctgagccaaattaaaatggaactagggaagtttatggaggaccctgacaaatatatcaaagtgttttataaactgggcttaacatctgaactcaccaggagggacctctcagtcatactagggcaaactctgcctaagggagaatgtgactccattatggtggcggtccaacaatttgcaaacacaatgcacatgcctgacactggtggctaccctgtgggggccaccatagttccccaggtcaaccccaattgggattacaatatccaggggagtacatgagcaaggacccacatgttcctctatctgatagaaggaatgaaagctagcagagcaaagcctgtgaactgtaataaattgggcttgacagatcaagggccttatgaaaacctcaccattttcttagacaggctagaagaggccctagtgaaacacactaacctagacccagacccactagaaggacaactgttcataaaggatcatttccctaactcaaacaacaccagatattaggaggaaacaccagaaactagcactggatcccagtacccctatgcctgacatctgcaaagtaggttccttggtcttttacaaccaaaaccaggaggagtaggaaagggctcaagaaaaggagaggcaaaaggaaaagcaacagctccaactactgactgccctgcaaacctgccagccacctctggcaggccccagggagatccctttgcccaaatgctacttctgtggggagccaggccacacaagaaggcagtgcccaaactgatggggacacccacccccagctctccatgctccaattgccacaatcttggccactgggaaacaggactaccctgaaagctgaaaggccctcaggacatcccaactggatgaccttcagctccttgagctgaagggggccctacgctccacttggctcctggattaaataacactattgaagggacagagccaagggctgccttggatgtgcccagtaggactgtaagttttcttttggacatgagggctgcctgctcaatgcttacctcttttcccaggcaattatcctcctgggaggatatgaagtgcccgtaacctggaggtttactcctcctctgtgctgtctctgggggaaaaccgtcttttctcattcatttttagtgatgccagaataccctacataccttttgggtagagatattttgctcagactaggggctcagttaacctttcctccagggccaacaccccctttttcaaatgcaatcttatgcctcaaggaaaccatacacaaggatgaactgttcacagaccttcccatttatccagaggtctgggcctcaggaataacaggaaaggccataatggcaatgcctatagtaattcagcccaagaatccttctagctatccttgtagaaggcagtttcctcttcagctggaggccaaagagggatttcagcttctgactgaaaaatttcaaaaacatggattattaataccctataacaccccatcttacctgttaaaaagagcaatgaaaaatacaggctagtccaggacctgagaatcataaatgaggcagtagtcccaatacacccaatgatccccaactcatatgtaattcttccccaacctccagatgctcagtggtttccagtcttagaccttaaagactctttcttttgtatctccccctcgacccatcctcccaatttctatttgcatttgagtgggagaatgaaaaggaaggagtcaacagctcacctgcacagtgcttcaacagggtttcagagacagtccccattggtctgggcaagccctggctagagatttgcaggacctaagtcttgagaggagagagtgtctcctacaatacatggatgacctgttaatctgctccccaacaagagaactgggaatccaacatctagtccaaacaccaaacttccttgcagacagagaatacaacgtgtc

SEQ ID NO: 227 - DNA, 2802 bp, Homo sapiens
tgtggtcagaattcttacacaagagccaggaccaagccctgtagcctttctgtccaaacaacttgaccttactgttttagcctagccctcgtgtctgcgtgcagtggctgccgctgccttaatacttttagaggcccttaaaatcacaaattatgctcaactcactctctacagttctcataacttccaaaatctattttcttcctcacacctgatgcatatactttctgctccccgcctccttcagctgtactcactctttgttgagtctcccacaattaccattgttcctggcccgacttcaatccggcctcccacattattctggataccacacctgacccccatgactgtatcgctctgatccacctgacattcaccccatttccccatatttccttcttccctattcctcaccctgatcacatttggtttattgatagtagtttcaccaggcctaatcaccacacaccagcaaaggcaggctatgctataatgcaagccaccagcccgctttttagaacctctcatttcctttccattgtgggaatctatcctcaaagaaataacttctcagcgttccatctgctattctactactcctcagggattattcaggccccctcccttccctacacatcaagctcgaggatttgcccacccacccccgacccaggactggcaactcttaactccctcttaaagtggatagatgatctttgctggcaggggaccctccaatactttcaccctgatgaagttctattctttacttttatactcactcttattctcattcccattcttatgccaccctctacctctccccagctatctccactacactatcgaccttactattctctcctagccatttctaatccttccttagctaacaaccgctggctttgcatttccctttcttccagcgcctacacagctgtccccacttacatgcagattaggcaacatctcctgtctccctacacctctgaacttcctttaacagccctcacctttaccctcctgaagaactcatttactttctagacaggtccagcaagacctccccagacatttcacatcagcaagctgccgccctcctccgcacttacttaaaaaaacctttctccttatatcaactctactccccccatatttagacctctcacaacacaaactactattcctgtggccactggaattcccctgggtaacctttcaccttctcgatgttcctttactcttcatctccaaagccctcttcttgtttacttatacccagccctgtaaataacagtgaaaggttgctcgtagatactcaacgttttctcatacaccatgaaaatcgaacctcctcctctgtgcagttacctcatcagtccccattacaacctctgatggctgtggccctagctggatccctaggagtctgggtacaagacacccctttcagcactccttctcatctttttactttgcatctccagttttgcctcgcacaaggtgtcttcttcctctgtgtatcctctacctacatgtgtctacctgctaattggacaggcacatgcacactagttttccttactcccaaaattcaatttgcaaataggaccgaagagctccctgttcccctcatgacaccgacacgacaaaaaagagttattccactaattcccttgcttgtcagtttaagactttctgccttcactattgctctcggtactggaatagcaggcatttcaacctctgtcacgaccttccgtagcctctctaatgacttctctgctagcatcacagacgtatcacaaactttatcagtcctccaggcccaagttgactctttagctgcagttgtcctccaaaaccgccgaggccttgacttactgctgaaaaaggaggactctgtatattcttaaatgaagagtgttcattttacctaaatcaatctggcctggtgtatgacaacataaaaaactcaaggatagagcccaaaagcttgccaaccaagcaagtaattacgctgaacccccttggacaccctctaattagatgtcctaggtcctcccaattcttagtcctttaatacctgtttttctccttctcttattccgtttagtttttcaattcatacaaaaccgtatccaggccatcacgaataattctacacaacaaatgtttcttctaacaaccccacagtatcaccccttaccacaaaatcttccttcagcttaatctctcccactctaggttcccacgccgcccataatccctctcaaagcagccctgagaaacatagcccattatctctccataccaccccccaaaatttttgctgccccaacacttcaacactattttgttttatttttcttattaatataagaagacaggaatgtcaggcctctgagcccaagctaagccatcatatatcccctgtgacctgcacgtacacatccagatggcccgttccttccttaactgacgacattccaccacaaaagacatgaaaatggcctgttcctgccttaactgatgacattaccttgtgaaattccttctcctggctcatcctggttcaaaagctccctcactaagatcttgtgacccccccccacccctgcccgccagagaaccccctttttccctttacctacccaaatcttataaaatggccccacccctatctcccttcgctgactctcttttcggactcagcccgcctgcacccaggtgaaataaacagccttgttgctcacacaaagcctgtttggtgatctcttcacacggacgcgcgtgaaa

SEQ ID NO: 228 - DNA, 3585 bp, Homo sapiens
gtcaggcctctgagcccaagttaagccatcatatcatcccctgtgacccgcatgtacacatccagatggccggttcctgccttaactgatgacattccaccacaaaagaagtgaaaatggcctgttcctgccttaactgatgacattgccttgtgaaattccttctcctggctcatcctggctcaaaagctcccccactgagtaccttgtgacccccactcctgcccgccagagaacaaccccctttgactgtaattttcctttacctacccaaatcttataaaacggccccacccctatctcccttggctgactctctttttggactcagcccgcctgcacctaggtgaaataaacagctttattgctcacgcaaagcctgtttggtggtctcttcacatggacgcgcatgaaatttggtgccatgactcagatcgggggacctcccttgggacatcaatcccctgtcttcctgctctttgctccatcagaaagatccacctatgacctcaggtcctcagaccaaccagcccaaggaacatctcaccaattttaaatccagtaagtgacctcttcttactctcttctccaacctctctcactgtccctcaaccactttctcctttccactcttcaatctctcccttctttcaatttcaattcctttcattttctggtagagataaaggagacacgttttatccgtggacccaaaactccggcgccagtcacggactgggaaggcagccttcccttggtgtttaatcatgcagggacgcctctctgattattcacccatgtttcagaggtgtcagaccacgcagggacgcctgccttggtcctttgcccttagcggcaagtcccgcttttctggggtaggggcaggtaccccaaccccttctctccgtgtctctaccccttctccgcctttctgggggacaagaaacccccaaccccttctccttcacccttagcggcaagtcccgcttttctagaggagaggcaagtaccccaacctcgtatctctgtgccccaatcccttatttccatgcaccgacctcttatatctgtgccccaatcccttatttccgtgccccaacctcttacatctctgtgccccgatcccttatttccgtgccccaacctcttatatctctgcgccctgatcccttatttccacaccctgacctcgtatctctgtgccctgacccctttcccacttttctggagggtaagaacccccgaaccgcttccctctgtgtctctactctcccttttctttaaacttgcctccttcactatgggcaaccttccaccctccattcctccttcttcgcccttagcctgtgttcttaagaacttaaaacctcttcaactctcacctgacctaaaatctaagcatcttattttcttctgcaatgccacttgaccccaaacaaactcgactgcagttccaaatagccagaaaacggcactttcaatttttccatcctgcaagatctaaataattcttgtaaaatgggcaaatggtctgagatgcctgacgtccaggcattcttttacacattggtccctccctagtctctgtgcccagtgcaactcgtcccaaatcttccttctttccctcccacctgtcccctcagtcccaaccccaagcattgctgagtctttctaatcttccttttctacagacccatctgacctctcccctcctccccagactgctcctcaccaggccgagctaggtcccaattcttcctcagcctctgctcccccaccgtataatctttttatcacctcccctcctcacacccggtccagtttacagtttcattccttgagtagccctcccccacctgcccagcaatttcctcttaaaaaggtggctgaagctaaaggcatagtcaaggttaattcttctttttctttatcccaaatcacaagcgtttaggctgtttttaatcaaatataaaaacccagcccagttcatgactcctttggcagcaaccctgagccactttacagccctagaccctaaaaggtcaaaaggtgtcttattctcaatatacattttattacccaatctgctcccgacattaaataaaactccaaaaattaaattccggccctcaaaccccacaacaggatttaattaacctcgccttcaaggtgtacaataatagaaaaaagttgcaattccttgcctccaccgtgagacaaaccccagccacatctccagcacacaagaacttccaaacgcctgaaccgcagcagccaggcattcctccagaacctccttccccaggagcttgctacaagtgccagaaatctggccactgggccaaggaatgcccacagcccaggattcctcctaagtcgtatcccatctgtgtgggaccccactgaaaatcagactgttcaactcacctggcagccactcccagagcccctggaactctagcccaaggctctctgactgactccttcccagatcttcttggcttagcagctgaagactgacactgcccgattgcctcagaagactacgggaccatcacagatgctctaagtaactctcagagtggagggtaagtctttctccttcttaatcaatacggaggctacccagtccacattaccttcttttcaagggcctgtttccctcaccccaataactgttgtgggtattgacggccaagcttcaaaatccctgaaaactcccccactctggtgccaacttggacaacactcttttaagcactcttttttaattatccccacctgcccagttcccttattaagccaagatattttaagcaaattatctgcttccctgactattcctggactacagccccatctcattgccgcccttctccccaacccaaagcctccttcacatcttcctctcatatccccccaccttaacccacaagtatgggacatctctactccttccctggcaaccgatcacatgcccattaccatcccattaaaacctaatcacccttaccccgctcaaccccaatattccatcccacagcataccttgaaaggattaaagcctgttatcactcacctgctagagcatggccttttaaagcctataaactctccttatcattcccccattttacctgtcctaaaaccagacaagccttacaagttagttcaggatctatgccttatcaaccaaattgttttgcctatccaccccatggtgccaaagccatatactcacctatcctcaatacctccctccacaacccattattctgttctggatctcaaacatgctttctttactattcctttgcacctgtcatcccagcatctcttcgcttgcacttggactgaccctgacacccatcaggctcagcaaattacctgggctgtactgccgcaaagcttcacagacagcccccattacttcactcaagcccaaatttcttccttatctgttacctatctcagcataattctcataaaaacacacgtgctctctctgctgatcgtgtccgattaatctcccaaacttcaatcccttacaaaacaacaactcctttccttcctagaaatggttag

SEQ ID NO: 229 - DNA, 5868 bp, Homo sapiens
gtcaggcctctgagcccaagccaagccatcgcatcccctgtgacttgcacatatacgcccagatggcctgaagtaactgaagaatcacaaaagtgaatatgccctgccccaccttaactgatgacattctaccacaaaagaagtgtaaatggccactccttgccttaagtgatgacattaccttgtgaaagtccttttcctggctcatcctggctcaaaaagcacccccactgagcaccttgcgacccccactcctacctgacagagaacaaaccccctttgactgtaattttcctttacctacccaaatcctataaaacggccccacccttatctccctttgctgactcttttcagactcagcctgcctgcacccaggtgaaataaacagccttgttgctcacacaaagcctgtttggtggtctcttcacacagacgcgcatgaaatttggtgccgtgactcggatcaggggacctcccttaggagatcaatcccctgtcatgttctttgctccgtgagaaagatccacctacaacctcaggtcctaagaccgaccagcccaagaaacatctcaccaatttcaaatccggtaagcggcctctttttactctcttctccaacctccctcactatccctcgacctctttctcctttcaatcttggtgccacacttcaatctctcccttctcttaatttcaattcctttcattttctgggagagacaaaggagacacgttttatccgtggacccaaaactccggtgccagtcacagactgggaaggcagccttcccttgacctttaatcattgcagggatgcctctctgattattcacccacgtttcaaaggtgttagaccacgcagggatgcctgccttggtccttcacccttagcggcaagtcccgcttttctggggaaggggcaagtaccccaacccctcctctccttgtctctaccccttctctgcttttctgggggaggggcaagtacccctcaaccccttctccttcactcttagcagcaagtcctgcttttctagaggaggggcaagtaccccaacctcgtatctctgtgccccaatcccttatttccgtgccccaacctcttatatctctgtgccccaatcccttatttctgtgccctaacttaactctgcgccccaatcctttatttccgtgccccgaccccttatttccgtgccccaccccttatttccatgccctgaccccttatttctgcaccccatcccttatttccacgccctgacctcttatctctgcgccccaaccccttttctggaaggtaagaaccccgaaccccttccctccgtttctctgctctctcttttctctaggcttgcttccttcactataggcaaccttccaccctccattcctccttctactcccttggcctgtgttctcaaaaacttaaaacctcttcaactcacaccttacctaaaacctaaatgtcttattttcttctgcaatgccacttgaccccaatacaaactctacagtagttccaaatagccagaaaatggcactttgaatttttccatcctacaagatctaaataattcttgttgtaaaataggcaaatggtctgaggtgcctgacgtccaggcattcttttacacatcagtcccttcctagtctgtgcccagtgcaactcgtcccaaatcttccttctttccctcccgcctgtcccctcagtcccaacaccaagcgtcgctgagtctttctaatcttccttttctacagacccatctgacctctcccttcctccccaggctactccctgccaggccgagctaggtcccaattcttcctcagcctctgctactccaccctataatctttttatcacctcccctcctcacacctggtctggcttacagtttagttctgtgactagccctccccctcctgcccagcaatttactcttaaaaaggtggctggagctaaagccatagtcaaggttaatgctcatttttctttatcccaaatcagatagcgtttaggctctttttcatcaaatataaaaatccagcccagttcatgacttgtttggcaacaaccctgagacactttacagccctagaccctaaaaggtcaaaaggccgtcttattctcaaaatacattttattacccaatctgctcctgacattaaatataactccaaaaattaaattctggccctcaaaccccacaacaggatttaattaacctcgccttcaaggtgtacaataatagaaaaaagttgcaattccttgcctccactgtgagacaaaccccagccccatctccagcacacaagaacttccaaacgcctgaaccgcagtggccaggcgttcctccagaacctcctcccacaggagcttgctacacgtgccggaaatctggccactgggccaaggaatgcccgcagcccgggattcctcctaagccccgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgctgagcttcaggtaactctaacagtggaaggtaagcccgtccccttcttaatcaatacggaggctacccactccacattaccctcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctgcttccctgactattcctggactacagctgtatctcattgccacccttcttcccaatccaaagcctcctttgcgtccccctcttgtatccccccaccttaacccacaagtataagatacctctactcccttcttggcaaccgatcatgcaccccttaccatctcattaaaacctaatcacccttaccccactcaacgccaatatcccatcccgcagcatgctttaaaaagattaaagcctgttatcactcgcctgctacagcatggccttttaaagcctataaactctccttaaaattcccccattttacctgtcctgaaaccagacaagccttacaagttagttcaggatctgcatcttatcaaccaaattgttttgcctttccaccccatggtgccaaacccatatactctcatatcctcagtacctgcctctacaacccattattctgttctagatctcaaacatgctttctttactatccctttgcacccttcatcccagcctttcttcgctttcacttggactgaccctgacacccatcaagctcagcaaattacctaggctgtactgccacaaagcttctcagacagcccccattacttcaatcaagcccaaatttcttcctcatctgttacctatctcggcataattctcataaaaacacacgtgctctccctgccaatctgtctgactgatctctcaaacccaagcaccttctacaaaacaacaactcctttccttcctaagcacggttagcgcagtcagaattcttacacaagagccaggaccacatcctgtagcccttctgtccaaacaacttgaccttactgttttagcctagccctcatgtctgcgtgcagcggctgctgctgctttaatacttttagaggccctcaaaatcacaaactatgctcaactcactctctacagttctcataacttccaaaatccattttcttcctcatacctgacgcatatactttctgcttcccggcgccttcagctgtactcactctttgttgagtctcccacaattaccgttgttcctggcccagactccaatccggcctctcgcattattctggataccacacctgacccccatgactgtatctctctgatccacctgacattcaccccatttccccaaatttccttctttcctgttccttaccctgatcacgcttgatttattgatggcagttccaccaggcctaatcgccacacaccagcaaaggcaggctatgctatagtacaagccactagcctgcctcttagaacctctcatttcctttccatcgtggaaatctatcctcaaggaaataacttctcagtgttacatctgctattctactactcctcagggattattcaggccccctcccttccctacacatcaagctcgaggatttgctcccacccaagactggcaaattagctttactcaacatgccccgagtcagataactaaaatacctcttagtctaggtagacactttcactggataggtagagtcctttcctacagggtctgagaaggccactgcagtcatttcttcccttctgtcagacataattcctcagtttagccttcccacctcaatacagtctgacaacagacaagcctttattagtcaaatcagccagcagtttttcaggctcttagtattcagtgaaacctttatatcccttacggtcctccatcttcaagaaaagtagaatagactaaaggtcttttaaaaacacacctcaccaagctcagccaccaacttaaaaaggactggacaatacttttaccactttcctttctcagaattcaggcctgtcctcggaatgctacagggtacagcccatttaagctcccgtacagacgctccttattaggccccagtctcattcgagacaccagaccaacttagactgtgccccagaaaacctgtcatccctactatcttctgtctactcatactcctattcaccgttctcaactactcatacatgccctgctcttgtttacactgccagtttacactgtttttccaagccatcacagctgatatctcctggtgctgtccccaaactgccactcttaactcttgaagtaaataaataatctttgctggcaggactatgctgaatctccttaggcgctctctaatcagatatcctgagtcgtcccaattcttagaccttttatacctgtttttctccttctgttattccatttagtttctcaattcatccaaaaccgtatctaggccatcaccaatcattctacacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccatatcaccccccaaaaatttttgctgccccaacacttcaacactattttgttttatttttcttattaatataagaagtcaggaatgtcaggcctctgagcccaagccaagccatcgcgtcccctgtgacttgcacatatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactcctgcccgccagagaacaaacccccttggactgtaattttcctttacctacccaaatcctataaaatggccccacccttatctccctttgctgattctcttttcggactcagcccacctgcacccaggtgaaataaacagccatgttgctcacacaaagcccgtttggtggtctcttcacacggacgtgcatgaaa

SEQ ID NO: 230 - DNA, 437 bp, Homo sapiens
gtcaggcctctgagcccaagctaagccatcatataccctgtgacctgcacgtatacatccagatggcctgaagccactgaagaaccacaaaagtgaaaatagccagttcctaccttaactgatgacattccacgattgcgatttgttcctgcccttccctaactgatcaatggaccttgtgacactccttctcctggacaatgagtctcaggagctccccactgagcaccttgtgacccccacccctgcccgcaagagaaaaaccccctttaactgtaattttccactacctacccaaatcctataaagactgcctcacccctatctccctttgctgactcctttttcgaactaagtcggcctacacccacatgattaaaagctttattgctcacccaaagcctgtttggtggtctcttcacactgacgcgcgttaa

SEQ ID NO: 231 - DNA, 5917 bp, Homo sapiens
gtcaggcctctgagcccaagccaagccatcacatcccctgtgacttgcacgtatatacgcccagatggcctgaagtaactgaagaatcacaaaagaagtgaatatgtcctgcctcaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactcctgcccgccagagaacccccctttgactgtaattttcctttacctacccaaatcctataaaacggccccacccctatctcccttcgctgactctcttttcggactcagcctgcctgcacccaggtgaaataaacagccatgttgctcacacaaagcctgtttggtggtatcttcacacggacgcgcatgaaatttggtgccgtgacttggatcgggggacctcccttgggagatcaatcccctgtcctcctgttctttgctccgtgagaaagatccacctacgacctcaggtcctcagacccaccagcccaaggaacatctcaccaattttaaatcaggtaagcggcctcttcttactctcctctccaacctctctcactgtccctcaaccactttctcctttccactcttcaatctctcccttctcttaatttcaattcctttcattttctgggagagacaaaggagacacattttatccatggacccaaaactccggtgccagtcacggactgggaaggcagctttcccttggtgtttaatcattgcagggacacctctctgattatacacccacgtttcaagagtgtcagaccacgcagggacgcctgccttggtccttcacccttatcggcaagtcccacttttctggggaaggggcaagtacctcaaccccttctctccttgtccctaccccttctctgcttttccggggacagggcaagtaccccaaccccttctctccttgtctctacccttctctgcttttctgggagaggggcaagtacccctcaaccccttctccttcactgttagcggcaagtcccgcttttctgggagaggggcaagtacccctcaaccccttctccttcactcttagtggcaagtcccgcttttctagaggaggggcaagtaccccaacctcatatctctgtgccccaatcccttatttccgtgccccgacctcttatctctgtgccccaatcccttatttccgtgccccgaccccttatttctgcgccccatcccttatttccatgccccaacctcttatctctgcaccccaaccccttttcccacttttctggaaggtaagaacccccaaaccccttcccttcgtttctctactctcccttttctctaggcttgcttccttcactatgggcaaccttctaccctccattcctccttctactcccttggcctgtgttctcaaaaacttaaaacctctttaactcacacctgacctaaaacctaaatgccttattttcttctgcaataccacttgaccctgatacaaactcgacagtagttccaaatagccagaaaattgaactttgaatttttccatcctgcaaaatctaaataattcttgtcgtaaaataggcaaacagtctgaggtgcctgacgtccaggcattcttttacatatcagtcccttcctagtctctgggcccagtgcaactcatcccaaatcttccttctttccctcccacctgtcccctcagtaccaaccccaagcgtcactgagtctttctaatcttccttttctacagacccatctgacctctcccttcctccccaggctgctcctcgccaggccgagctaggtcccaattcttcctcagcctctgctcctccaccctataatctttttatcacctcccctcctcacacctggtccggcttacagtttcgttccgtgactagccctccccctcccgcccagcaatttactcttaaaaaggtggctggagctaaaggcatagtcaaggttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaaagttgcaattccttgcctccactgtgagacaaaccccagccacatctctagcacacaagaacttccaaacgcctgaatcacagcggccaggcattcctccagaacctcctcccccaggagcttgctacatgtgccagaaatctggccactgggccaaggaatgcccgtagcccgggattcctcctaagccgcatcccatctgtgtgggaccccactgaaaatcggacggttcaactcacctggcagccacttccagagcccctggaactctggcccaaggctctctgactgactccttcccagatcttcttggcttagtggctgaagactgacactgcccgatcgcctcggaagctccctagaccatcacggacgccgagcttcgggtaactctcacagtggaaggtaagcccgtccccttcttaatcaatacggaggctacccactccacattaccttcttttcaagggcctgcttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaaattatctgcttccctgactattcctggactacagctatatctcattgccgcccttcttcccaatccaaagcctcctttgcatcctcctcttgtatcccccaaccttaacccacaagtataagatacctctactccctccttggtgaccaatcatgcatcccttaccatttcattaaaacctaatcacccttaccccactcaacaccaatattccaccccacagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctgcctctacaacctattattctgttctagatctcaaacatgctttctttactattcctttgcacccttaatcccagcctctctttgctttcacttggactgaccctgacacccatcaagctcagcaaattacctaggctgtactgctgcaaagcttcacagacagcccccattacttcaatcaagcccaaatttcttcctcatctgttacctatctcggcataattctcataaaaacacacgtgctctccctgccaatcatgtctgactgatctctcaaactccagcacctcctacaaaacaacaacttctttccttcctaggcatggttagtgcggtcagaattcttacacaagagccaggaccacaccctgtagcctttctgtccaaacaacttgaccttactgttttagcctagccctcatgtctccgtgcagcggctaccactgctttaatacttttagaggccctcaaaatcacaaactatggtcaactcactctctacagttctcataacttccaaaatctattttcttcctcatacctgacgcatatactttctgctccccggctccttcagctgtagtcactctttaagtcccacaattaccattgttcctggcccggacttcaatctggcctcccacattattcctgataccgcacctgacccccatgactgtatctctctgatccacctgatattcaccccatttccccatatttccttctttcctgttcctcaccctgatcacgcttgatttattgatggcggttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcgatgcagtctgataacagaccagcctttattagtcaaatcagccaagcagtttttcaggctcttagtattcagtgaaacctttatatcccttacgttcctccatcttcaagaaaagtagaatggactaaaggtcttttaaaaacacacctcaccaagctcagccaccaacttaaaaaggactggacaatacttttaccactttcccttctcagaattcaggcctgttttcagaatgctacagggtacagcccatttaagctcctgtatagacgctcctttttattaggccccagtctcattccagacaccagaccaacttagactgtgccccccaaaaaacttgtcatccctactatcttctgtctagtcatactcctattcaccgttctcaactactcatacatgccctgctcttgtttacactgccggtttacactgtttttccaagccatcacagctgatatctcctggtgctatccccaaactgccactcctaactcttgaagtaaataaataatctttgctggcaggactatgctgaatctccttaggcactctctaatcagatatcctgagtcgtcccaattcttagaccttttatacctgtttttcttcttctgttattccatttagtttctcagttcatccaaaaccgtatccaggccattaccaatcattctatacgacaaatgtttcttctaacattcccacaatatcatcccttaccacaagacctcccttcagcttaatctctcccactctaggttcccatgccgcccctaatcccacttgaagcagcccggagaaacatcgcccattctctctccataccaccccccaaaaattttcgccgccccaacacttcaacactattttgttttatttttcttattaatataagaaggcaggaatgtcaggcctctgagcccaagccaagccatcacatcccctgtgacttgcacgtatacacccagatggcctgaagtgactgaagaatcacaaaagaagtgaatatgccctgcctcaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaacggccccacccctatctcccttcgctgactctcttttcggactcagcctgcctgcacccaggtgaaataaacagccatgttgctcacacaaagcctgtttggtggtctcttcacacagacgcgcatgaaa

SEQ ID NO: 232 - DNA, 4056 bp, Homo sapiens
cccctccctcggcagctcgtttacgacccaaaacggggatacaaatgcccctgagagagcagcggtatactgggatagatgaggatggtcacgtggtggagaggcgtgtttttgggtaccagcccttcacctgcgtcgaccttctcaactggaaaaccaatacaccgccctataccaaaaagccacaagccctaattgatttgctccaaactgttatccagacccacaaccacacctgggctgattggcacctgttgctcatgttcctctttaacagcgaagaaaggcggagagtccccaagcagcaactaagtggctagaggaacatgcatcagctgattatcaaaacccccaagagtatgtaaggacccagttaccaggaaccgacccccagttggacccacatgaaagagaggatatgcaaaggctaaaccgagacagggaagctctcttggaaggattaatgaggggagctcagaaggccacaaatgttaaaaaggtctctgaggtcattcagggaaaagaagaaagtccagcacaattctacgagaggctgtgtgaggcctattgtatgtatactccctttgatcccgatagccctgaaatcagcgcatgattaacatggctttagtccgtcaaagcacagaagacatgagaagaaaactgcagaaacaggctgggcttgcagggatgaatacatcacaattactagaaatagctagccaggtgtttgtaagcagggatgcagtaagcagtaaggaaaacggcaaagagaatggaggtcaggcccagcaaaacaccgacctgtttgttagctgcagcaatcagagggccccccacccaaagaggcaagggaaggggggccctgggaaagaaactcagcttggctgtcagagtttgcagcgtaaccagtgtgcttattgtaaagaaataggacagcggaagaacaaatgccctcagctcaaaagaaaacaaggtgactcagagcaggagggcccggagaaggaggaaggggccctgctcaacctggcagaagggttattggcctgagggagaccgggctcaagtgtccccaaagagcctctggtcagaatgacagtcgggggtagagacattgattttcttgtagatagtggtgctgaacattcgctagtaaccgccccggtcgcccccttatccgaaacaactattgacgtcatcggagccacgggggtttcagcaaagcaggctttctgcttgcctcggacttgcactgtaggaggacataaagtcattcatcagttttggtacatgcctgactgtcccttgccctttttgggaagggacttgctcagcaagctgagagccactatctctttgacagagcatggctctttgctgctaaagttacccggaacaggagtcattatgacccttatggtcccccgagaggaggaatggagacttttcttaactgagctgggccaagagagaagaccagctctggctaagcggtggccaagagtacgggtggaagacaaccctccgggattggccagttaagactggggcccagccggttaggcaaaaacaggccctggtccccagagaagctcttcaaggtatccaggtccatctcaagcacctaagaacttttggaattattgttccttgtcagtctccatggaacactcccctcctgcctgttcccaagccacggaccaaggactaccggccggtacaggatttgcacttgcttaatcaagctacactgactttacgtccaacagtacctaacccatccacattgttggggttgctgccagctgaggacagctggttcacctgcttggacctgaaagatgctttctttcctatcagattagcccctgagaggcagaagctgtttgcctttcagtgggaagatccggagtcaggtgtcactactcagtacacttggactggacttccccaagggttcaagaactccccaccatcttcagggaggcattggcttgagacctccagagtttcccaccagagacctaggctgtgtgttgctccagtaggttaagacaccccacggcggtcgggtgcgccaagggaacagatgccctacacaggcacctggaggactatgggtattaggtgtccaagaagaaagctcagatctgcggacggcaggtaccttacttgggatttactatccgagaggggtcggaatgcagccctggatcagaaagaaagcaggtcatttgcaacctaccagagcctcagggcagaaggcaagtgagagaattcttaggagctgtggggttttgtagactgtggatcccaaactttgcagtattagccaagcctttgtatgaggtcacaaagggggcagggactgggaacttttggaatggggatcccaacaacaggaagtctttcatgagttaaaggaaaaccttctggcagccccagccttggggctacccgatctgacaaagcctcttccattgtatgtgtcagagagagaaaagatggcagctggacttttaacccaaactgtggggccctggctgaggccagtggcctacctctctaaacaactagatggggtttctaaaggatggtccccctgtttgagggccttggcagcaactgccctgctagtacaagaagctaataagctgactcttgggcaaaacctgaacataaaggccccccatgctgtggtgactttaatgaatactaaaggacatcattcgctaacgaatgccagactcatcaagcaccaaactttgctctgtgaaaatccctatataactattgaagtttgtaacaccctacaccctgccaccttgctcccggtaccagagagccctgtccagcctgattgtgtagaagtgttggactcagttgactctagcacacctgacctccgggaccagccttgcacatcagtagactgggaactatatgtggatgggagcagcttcttcaacccccaaggagagagagatgcagggtatgcagtggtaaccctggacactgttgttgaagccagattgttgccccaggccacttcagcccagaaagcggaactcattgctttcactcgggccttagaactcagtgaaggtgagactgtaaacatttacactgattcttggtatgtcttttaacccttcaagtgcatggagcatgatagaaagaaaagggcctattgaactctgggggaaaagacagaaaatatcaacaagaaatcttgcaattattaaaagcagtatggaaaccccacaaggtggcagtcatgcattgcagaggacaccagcgagcttccaccttgctgggtttggggaattccctcgctgactcagaggctcgaagaagcagcatttgcccccttctgggcatcagtgctccctcaagcacctgatcttggacctacttcttctaaagaagaaaaggactttctccaggtagagggaaggacaagtgatggagggaggatggattcagttaccagatgtgagaatagctgtgccacagttgctaggagctgcagttgtactggctgtgcaagaaaccacccatgtaggtcaggagtcactggaaaagttgttaggccggtatttctacatctcacatttgtcagcccttgccaaaatgctgaggcagcggtgagttacctgccgagagcataatgcgaggcaaggtccagccgttccgcccggcatacaagcttatggagcagtcccctttgaagatctccaggtagacttcacagagatgccaaagtgtggaggtaccaagtatttactagttcttgggcgtacctactctgggtgggtggaggcctatcaaacacaaactgagaaagctggtgaagtaaaccctgtgctccttcgagatctgattcctagatttcgactgtccttacggatcagctcagataacaagcctgcgtttttggctgccttggtacagaagacggcaaaggtattggggatcacacggaaactgcgtgccgcctcccagcctcagagttccagaaaggtggagcggatgaatcggagtatcaaaaatagt

SEQ ID NO: 233 - DNA, 4093 bp, Homo sapiens
tgactctcttcggactcagcccgcctgcacccaggtgaaataaacagccatgttgctcacacaaagcctgtttggtggtctcttcacacggacgcgtatgaaatttggtgccgtgactcggatcgggggacctcccttgggagatctatcccccgtcctcctgctctttgctccatgagaaagatccacctacgacctcaggtcctcagaccaaccagcccaggaaacatctcaccaatttcaaatccggtaagcggcctctttttactctcttctccaacctccctcactatccctcaaccccttctccttcaccctcagcggcaagtcccgctttcctgggacaggggcaagtacccctcaaccccttctccttcaccctcagcggcaagtcctgctttcctggggcaggggcaagtacccctcaaccccttctccttcaccctcagcagcaagtcccgctttcctagggggcaagaaccccccaatcacttatttctgcaccccaacctcttatctctgcgccccaatcccttatttccgcaccctgacctcttatttccgtgccccaaccccttctctgcttttctggagggcaagaaccccccaccccttctccgtgtctctactcttttctctgggcttgcctccttcactatgggtaagcttccaccttccattcctccctcttctcccttagcctgtgttctcaaaaacctaaaacctcttcaactaacacctgacctaaaacctaaatgccttattttcttctacaatgctgcttgaccccaatacaaattcgacagtagttccaaatagccggaaaacggcactttcaatttttccatcctacaagatctaaataattattgtcgtaaaatgggcaaatggtctgaggtgcctgacgtccaggcattcttttacacatcagtcccttcctagtctctgtgcccagtgcaactcgtcccaaatcttccttctttccctcccgcctgtcccctcagtcccaaccccaagcgtcgctgagtctttctaatcttccttttctacagacccatctgacctctcccctcctcaccagcccaagctaggtcccaattcttcctcagcctccactcctccaccctataatccttctatcacctcccctcctcacacctggtctggcttacagtttcgttctgtgactagccctcccccacctgcccagcaatttattcttaaaaaggtggctggagctaaaggcatagtcaaggttaatgctcctttttctttatcccaaatcagacagcgtttaggctttttcatcaaatataaaaacccagcccagttcatggctcgttcagcagcaaccctgagacgctttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagtggccaggcgttcctccagaacctcctcccacagaagcttgctacaagtgccagaaatctgaccaccaggccaaggaatgcctgcagcccaggattcctcctaagccgtgtcccatctgtgcgggaccccactggaaattggactgttcaactcacctggcagccactcccagagcccctggaactctggcccaaggctctctgactgactccttctcggcttagcagctgaagactgatgctccccgattgcctcggaagccctgtagaccatcatggacgccaagctttgggtaactctcacagtggaaggtaagtccgtccccttcttaatcaatacggaggctacccactccacattaccttcttttcaagggcctgtttcccttgcctccataactgttgtgggtattgacagccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcatcctcctcttatatccccccaccctaacccacaagtataagatacctctactccctccttggcgaccgatcatgcaccccttaccatctcattaaaacctaatcacccttaccccactcaacgccaatatcccatcccgcagcatgctttcaaaggattaaagcctgttatcacgcgcctgctacagcatggccttttaaagcctataaactctccttaccattcccccattttacctgtcctaaaaccagacaaggcttacaggttagttcaggatctgcgccttatcaaccaaattgttttgcctttccaccctgtggtgccaaacccatatgctctcctatcctcaatacctccctctactacccattattctgttctagatctcaaacatgctttctttactattcctttgcacccctcgtcccagcctctctttgctttcacttagactgaccctgacatccattaggctcagcaaattaccaaggctgtactgccgcaaagcttcacagacagcccccattacttcaatcaagcccaaatttcttcctcatctgttacctatctcggcataattctcataaaaacacacgtgctctccctgccaatagtgtccgactgatctctcaaaccccagcaccttctacaaaacaacaactcctctccttcttaggcatggttagcgtggtcggaattcttacacaagagccaggaccacatcctgtagcctttctgtccaaacaacttgaccttactgttttagcctagccctcatgtctgcgtgcagcggctactgctgctttaatacttttagaggccctcaaaatcacaaactttatcagtcctccaggcccaagttgactctttagctgcagttgtcctccaaaaccgccgaggccttgacttactgctgaaaaaggaggactctgcatattcttaaatgaggagtgttgtttttacctaaatcagtctggcctggtgtatgacaacataaaaaaactcaaggatagagcccaaaaacttgccaaccaagaaagtaattacgctgaacccccttgggcactctctaactggatgtcctgggccctcccaattcttagtcctttaatacccatttttctcctccttttattcggaccttgtatcttccgtttagcttctcaattcatccaaaaccgtatccaggtcatcaccaatcattttatacgacaaatgtttcttctaacatccccacaatatcaccccttaccacaagacctcccttcagcttaatctctcccactctaggttcccacgccgcccctaatcccacttgaagcagctctgagaaacatcgcccattctctctccataccaccccccaaaaattttcgccactccaacacttcaacactattttgttttgtcttattaatataagaaggcaggaatgtcaggcctctgagcccaggcaaggccatcgcatcccctgtgacttgcacgtatacatccagatagcctgaagtaactgaagatccacaaaagaagtaaaaacagccttaactgatgacattccaccattgtgatttgttccttccccaccctaactgatcaatgtactttgtaatctcccccacccttaagaaggtactttgtagtctcccccacccttaagaaggttctttgtaattctccccacccttgagaatgtactttgtgagatccacccctgcccctttgactgtaactttccattaccttcccaaatcctataaaacggccccacccctatctcccttcgctgactctcttttcggactcagcccacctgcacccaggtgaaataaacagctttattgctcacaaaaa

SEQ ID NO: 234 - DNA, 6005 bp, Homo sapiens
gtcagtcctctgagcccaagctaagccatcatatcccctgtgacctgcacatacacatccagatggccggttccttccttaactgatgacattccaccacaaaagaagtgaaaatggcctgccttaactgatggcattgtcttgtgaaattccttttcctggttcatcctggctcaaaagctcccctactgagcaccttgtgacccccactcctgcccaccagagaacaacccccctttgactgtaattttcctttatctacccaaattttataaaacagccctacccttatctcccttggctgattctcttttcggagtcatcccgcctgcacccaggtgaaataaacagccttgttgctcacacaaagcctgtttggtggtctcttcacacggacgcgagtgaaatttggtgccgtgactcggatcgggggacctcccttgggagatcaatcccctgtcctcctgctctttgttccgtgagaaagatccacctacgatctctggtccttagaccaaccagcccaaggaacatctcaccaattttaaatccagtaagcggcctctttttactctcttctccaacctctctcacgatccctcaacctctttctcctttcaattttggcgccacacttcaatctctcccttctcttaatttcagttcctttccttttctggtagagatgaaggagacgtgttttatctgtggacccaaaactccggcgctggtcacggacttgggaagacagtcttcccttggtgtttaatcacgcagggacgcctgcctgattattcacccacgtttcagaggtgtctgaccatgtggggatgcctgccttggtccttcacccttagcggcaagtaccgcttttctgaggggcatgaaccccccaacccttctctctgtgtctctaccccttctctgcttttctggggggcaagaagcccccaccccttatctccgtgtctctactctctcttttctctgggcttgcctccttcactatgggcaagcttccgccctccattcccccttagcctgtgttcttaaaaacccaaaacctcttcagctcacacctgacctaaaacctaaatgccttattttcttctgcaatgccgcttgaccccaatacaaactcgagagttgttccaaatagccagaaaatggcactttcaatttttccatcttacaagatctaaataattcttgttgtaaaatgggcaaatggtctgaggtgcctgacatccaggcattcttttacacatcggtcccaccctagtctctgtgcccagtgcaactcatgccaaatcttccttctttccctcccaccggtcccctcagtcccaaccccaagcgtcactgagtctttctaatcttcattttctacagacccatctgacctctcccctcctccccagggcgagctaggtcccaattcttcctcagcctctgctcctccaccctataatccttttatcacctcccctcctcacagctggtccggcttacagtttcattctgtgactagccctccccgacctgcccagcaatttcctcttaaaaaggtggctggacctaaaggcatagtcaagattaatgctcctttttctttatcccaaatcagatagtgttttggctctttttcatcaaatataaaaacccagcccagttcatggctcgtttggcagcaaccctgagatgctttatagccctagaccctaaaaggtcaaaaggccgtcttattctcaatatacattttattaccaaatctgctcccgacattaaataaaactccaaaaattaaattctggccctcaaaccccacaacaggacttaattaaccttgccttcaaggtgtgcaataatagagtagaggcagccaagtagcaacatatttctgagttgcaattctttgcctccactgtgagacaaaccccagccacatctccacacacaagaacttccaaacgcctaaacctcagtggccaagtgttcctccaggcccgcctcccccaggagcttgctacaagtgccagaaatctggctaccaggccaaggaatgcccacagcccagaattcctcttaagccacgtcccatctgtgcgggaccccactgaaaatcagactgttcaactcacctggcagtcattcccagagcctctggaactctggcccaaggctctctgactccttcccagatcttctcggcttagcagctgaagactgacactgcccgatcgcctcggaagccccttagaccatcacggatgccgagcttcgggtaactcttacagtggaaggtaagtctgtccccttcttaatcaatacagaggctacccactccacattaccttcttttcaagggcctgtttcccttaccttcataactgttgtgggtattgacggccaggcttctaaacctcttaaaactccccaactctggagccaacttagacaatactcttttaagcactcttttttagttatccccagctgcccagttcccttattagaccgagacactttaactaaattatctgtttccctgactattcctgggctacagcaacacctcattgccgccttttcccccagttcaaagcctccttcacatcctccctttgtatctccccaccttaacccacaagtataagacacctctactccctccttagcaaccgatcatgcaccccttaccatcccattaaaacctaatcactcttaccccgctcaatgccaatatcccatcccacggcatgctttaaaaggattaaagcctattatcactcacctgctacagcatggccttttaaagcctgtcaactccccttacaattcccccattttacctgtcctaaaaccagacgaggcttacaggttagttcaggatctgcgccttatcaaccaaattgttttgcctatccaccccatggtgccaaacccatatactctcctatcctcaatacctccttccacaacccattattctgttctagatctcaaacatgctttctttactattcccttgcacccttcatcccagcctctcttcgctttcacttggactgaccctgacacccatcaggctcagcaaattacctgggctgtactgcccaaggctttacagacggcccccattacttcaatcaagcccaaatttcttcgtcatctgttacctatctcggcataattctcataaaaacacatgtgctctccctgctgatcgtgtccagctaatctcccaaaccccaatcccttctacaaaacaacaactcctttccttcctaggcatggttagtaaggtcagaattcttacacaagagctgggaccatgccctgtagcctttctgtccaaacaactggaccttactgttttagcctagcccttatgtctgcatgcagcagctgccgctgctttaatacttttaaaggccctaaaaatcacaaagtatgctccactcactctctacagttctcataactttgaaaatctattttcctcatacctgacgcatatactttctgatccccagctgcttcagctatactcactctttgttgagtctcccacaattaccattttttcctggcacggacttcaatccggcctcccacgttattctagataccacacctgaccctcatgactgtatctctctgatccacctgacattcaccccatttccccatatttccttctttcgtgttcctcacccttatcacatttggtttattgatggcagttccaccaggcctaaccgccactcaccagcaaaggcaggctatgctatagtatcttccacatctatcattgaggctactgctctgcccccctccactacctctcagcaagccgaactagttgccttaactcaagccctcactcttgcaaaaggactatgcgtcaatatttatactgactctaaatatgcctttcatatcctgcaccaccatgcaagaggtttcctcactacacaagggtcctctatcattaatccctctttaatgaaaatacttctcaaagctgctttacttccagaggaagctggagtcattcaccacaagggccatcgaaaggcatcagattccattgctctaggcaacacttacgctgataaggtggctagacaagaagctagcattccaacttctgtccctcaccgccagtttttctccttcatatcagtcactcccacctactcccccgctgaaacttccacctatcaatctcttcccacacaaggcaaatggttcttagaccaaggaaagtatctcctagccttagaggcccattgtattctgttgtcatatcataacctcttccatgtaggttacaagccactagcccctctcttagaacctctcatttcctttccattatggaaatctatccttaaggaaaccacttcttagtgttccatctgctattctactacccctcagggattgttcgggcctcctccctttcctacacatcaagctcagggatttgcccctgcccaggactggcaaattgactttactcacatgccccgagtcagaaaactaaaatacttcttagtctgggtagacactttcactggatgggtagaggccttccccacagggtctgagaaggccaccgcggtcatttcttcccttctgtcagacataattccttagtttggacttcccacctctatacagtccgatagcagactggactttattagtcaaatcagccaagcattttttcaggctcttggtattcagtgaaacctttatatcccttacggtcctcagtcttcaggaaaggtagaatggactactggtcttttaaaaacacacctcaccaagctcagccaccaacttaaaaaggactgtacaatacttttaccacttgcccttctcagaattcaggcctgtcctcggaatgctacagggtacagcccatttgagctcctgtatggacactcctttttattaggccccagtctcattccagacaccagactaacttggactgtgccccaaaaaacttgtcatccctactatcttctgtctagtcatactcctattcaccgttctcaactactcatacatgccctgctcttgtttacactgccagtttacactgtttctccaagccagcacagctgatatctcctggtgctatccccaaactgccactcttaactcttaaagtaaataaataatctttgctggcaggactatgctgaatctccttaggcactctctaattagatgtcctgggtcctcccaattcttacacatttaatacctgtttttctccttctcttattctgtttagtttttcaattcatacaaaactgtatccaggccatcatcaataattctaaatgacagatgtttcttctaacaaccccacaatatcaccccttaccacaaaatcttccttcagcttaatctctcccactctaggttcccatgccacccctaatcctgctcaaagcagccctgagaaacatcgcccattatctctccataccacccccaaacattttcaccgtcccaacactttaccactttttcattttatttttcttattaatataagaagacaggaatgtcaggcctctgagcccaacctaagccatcatatcccctgtgacctgcacgtacacatccagatggccggttcctgccttaactgatgacattccaccacaaaacaagtgaaaagggcctgttcttaccttaactgatgacattgtcttgtgaaattccttctcctggctcatcctggctcaaaagctcccctactgagcaccttgtgacccccactcctgcccgccagagaacaacccccctttgactgtaattttcctttacctacccaaatcttataaaacggccctacccttatctcccttggctgactctcttttcggactcagcccgcctgcacccaggtgaaataaacagccttgttgctcacacaaaggctgtttggtggtctcttcacacggacgcgagtgaaa

SEQ ID NO: 235 - DNA, 5841 bp, Homo sapiens
gtcaggcctctgagcccaagcccagccatcgcatcccctgtgacttgcacatatatgcccagatggcctgaagtaactgaagaatcacaaaagaagtgaatatgccctgccgcaccttaactgatgacattccaccacaaaagaagtgtaaacggccggtccttgtcttaagtgatgacattaccttgtgaaagtccttttccgagctcatcctggctcaaaaagcacccccactgagcaccttgggacccccgcccctgcccaccagagaacaaccccctttgactgtaattttcctttaccttcccaaatcctataaaacggccgcacccctatctcccttggctgactctcatttcggactcagcccgcctgcacccaggtgaaataaacagccatgttgctcacacaaagcctgtttggtggtctcttcacacggacacgcatgaaatttggtgccatgactcgaattgggggacctcccttgggagatcaatcccctgtactgctgttctttgctccatgagaaagatccacctacgacctcaggtcctcagaccgaccagcccaaggaacatctcaccaattttaaatcaggttagcggcctcttcttactctcttctccagcctctctctgtccctcaaccacactttctcctttccactcttcaatctctcccttctcttaatttcaattcctttcattttctgagacagacaaaggagacacgttttatccgtggacacaaaactctggcgccggtcacggactgggaaggcagctttcccttggtgtttaatcattgcagggacacctctctgattatacacccacgtttcaagggtgtcagaccacgcagggacgcctgccttggtccttcacccttagcggcaagtcccacttttctggggaaggtgcaagtacctcaaccccttctctccttgtccctacccattctctgcttttccggggacagggcaagtaccccaaccccttctctccttgtctctacccttctctgcttttctgggagaggggcaagtacctcaaccccttctctccgtgtctctaccccttctctgctttcctggggcaggggtaagtacccctcaaccccttctccttcacccttagcggcaaatcccactttcctagggggaaagaaccccccaatcgcttatttccgcaccccaacctcttatctctgcaccccaataccttatttccgcaccctgacctcttatctctgtgcctcaatcccttatttccgtgccccaaccccttctctgcttttctggagggcaggaacccctcaccccttctccgtgtctctactcttttctctgggcttgcctccttcactataggtaagcttccaccttccattcctccttcttctcccttggcctgtgttctcaaaaacttaaaatctcttcaactcacacctgacctaaaacctaaatgccttattttcttctgcaatgccgcttgaccccaatacaaactcgacagtagttccaaatagccagaaaatggcactttcaatttttccatcctacaagatctaaataattcttgtcataaaatgggcaaatggtctgaggtgcctgacgtccaggcattcttttacacatcagtcccttcctagtctctgtgtccagtgcaactcatcccaaatcttccttctttccattctgcctgtccccttagtcccaaccccaagcgtcactgagtctttctaatcttccttttctacagacccatctgacctcttccctcctcgccagcccaagctacgtcccaattcttcctcagcctccgctcctccaccctataatctttttatcacctcccctcctcacacctggtccggcttacagtttcgttccgtgactagccctcccccacctgcccagcaatttactcttaaaaaggtggctggagccaaagacatagtcaaggttaatgctcctttttctttatcccaaatcagatagcatttaggctttttcatcaaatataaaaacccagcccagttaatggctcgttcggcagcaaccctgagacactttacagccctagaccctaaaaggtcaaaaggccgtcttattctcaaaatacattttattacccaatctgctcccaacatcaaataaaacaccaaaaattaaattctggccctcaaaccccacaacaggatttaattaacctcatcttcaaggtgtacaataacagaaaaaagttgcaattccttgcctccactgtgagacaaaccccagccacatctccagcacacaagaacttccaaatgcctgacccacagcggccaggcattcctccagaacctcctcccccaggagcttgctacatgtgccggaaatctggccactgggccaaggaatgcccgcagcccgggattcctcctaagccgcgtcccctctgtgtgggaccccactgaaaatcggactgttcaactcacctgacagccactcccagagcccctggaactctggcccaaggctctctgactccttcccagatcttctcagcttagcggctgaagactgacactgcccgatcccctcggaagccccctaaaccatcatggacgccgagcttggggtaactctcacagtggaaggtaagcccgtccccttcttaatcaatacggaggctacccactccatattaccttcttttcaagggcctgtttcccttgcctccataactgttgtgggtattcacggccaggcttctaaacctcttgaaactccccaactctggtgctaacttggacaatactcttttaagcactcctttttagttatccccacctgcccagttcccttattaggctgagacactttaaattatctgcttccctgactattcctagactacagctatatctcatggccgccctttttcccaatccaaagcctcctttgcgtcctcctcttgtatccccccaccttaacccacaagtataagatacctctactccctccttggagaccgatcatgcaccccttaccatctcattaaaacctaatcacccttaccccactcaacaccaatatcccatcccacagcaggctttaaaaagattaaagcctgttatcactcgcctgctacagcatggtgttttaaagcctataaactctccttataattcccccattttacctgtcctaaaaccagacaagccttacaatttagttcaggatctgcaccttatcaaccaaattgttttgcctatccaccccgtggtgccaaacccatatactctcctatcctcaatacctgcctctacaacccattattctgttctggatctcaaacatgctttctttactattcctttgcatccttaatcccagcctctcttcgctttcacttggactgaccctgacacccatcaagctcagcaaattacctaggctgcactgccgcaaagcttcacaaacagcccccattacttcaatcaagcccaaatttcttcctcatctgttacctatctcggcataattctcataaaaacacatgtgctctccctgccaatcgtgtccaactgatctctcaaaccccagcaccttctacaaaaccacaactcctttccatcctaagcatggttagctcggtcagaattcttacacaagagccaggaccacaccctgtagcctttctgtccaaacaacttgaccttactgttttagcctagccctcatgtctgcgtgcagcagctgccactgctttaatacttttagaggccctcaaaatcacaaactgtgttcaactcactctctgcagttctcataacttccaaaatctattttcttcctcatacctgacgcatatactttctgcttcccggctccttcagctgtactcactgtttgttgagtctcccacaattaccattgttcctggcccatacttcaatccagcctcccacattattcctgataccacacctgacccccatgaccgtatctctctgatccacctgacattcacatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccattgtggaaatctatcctcaaggaaataacttctcagtgttccatctgctattctactactcctcagggattattcaggccccctcccttccctacacatcaagctcgaggatttgccccacccaggactggcaaattagctttactcaacatgccccgagtcggataactaaaatacctcttagtctaggtagacactttcactggataggtagaggcctttcctacagggtctgagaaggccaccacagtcatttctacccttctgtcagacataattcctcagtttagccttcccatctcaatacagtctgataacagaccagcctttattagtcaaatcagccagcagtttttcaggctcttagtattcagtgaaacctttatatccctcacggtcctgcgtcttcaagaaaagtagaatagactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccgactttgactgtgccccaaaaaaaattgtcatccctactatcttctgtctagtcatactcctattcaccgttctcaactactcatacatgccttgctcttgtttacactgccggtttacactgtttctccaagccatcacagctgatatctcctcctgctatccccaaactgccactcttaactcttgaagtaaataaataatctttgctggcaggactatgctgaatctccttaggcactctctaatcagatatcctgagtcatcccaattcttagaacttttatacctgtttttctccttctgttattccatttagtttttcaattcatccaaaaccgtatccaggccatcaccaatcattctatacgacaaatgtttcttctaacatccccacaatatcaccccttaccacaagacctcccttcagcttaatctctcccactctaggttcccacactgcccctaatcccgcttgaagcagctctgacaaacatcgcccattctctctccataccactccctaaaaattttcgctgccccaacacttcaacactattttgttttatttttcttattaatgtaagaagtcaggaatgtcaggcctctgagcccaagccaagccatcgcatcccctgtgacttgcacgtataagccccgatggcctgaagtaactgaagaatcacaaaagaagtgaatatgccctgccccaccttaactgatgacattccaccacaaaagaagtgtaaatggccgttccttgccttaagtgatgacattaccttgtgaaagtccttttcctagctcatcctggctcaaaaagctcccccactgagcaccttgggacccttgcccctgcccaccagagaacaaccccctttgactgtaattttcctttaccttcccaaatcctataaaatggccccacccctatctcccttggctgactctcatttcggactcagcccgcctgcatccaggtgaaataaacagccatgttgctcacacaaagcctgtttggtggtctcttcacacggacgcgcatgaaa

SEQ ID NO: 236 - DNA, 5687 bp, Homo sapiens
gtcaggcctctgagcccaagctaagccatcatatcccctgtgacctgcatgtacacatccagatggcctgttcctgccttaactgatgacattccaccacaaaagaaatgaaaatggcctgttcctgccttaactgatgacattatcttgtgaaattctttctcctggctcatcctggctcaaaagctcccctgagcaccttgtgacccccactcctgcctgccagagaacccccctttttcctttacctacacaaatcctataaaacggccccacacctatctcccttagctgactctcttttcaggctcagcccgcctgcacccaggtaaaataaacagccttgttgctcacacaaagcctgtttggtggtctcttcacacggacgcacatgaaatttggtgccgtgactcggattgggggacctcccttgggagatcaatcccccgtctttgctccctgagaaagatccacctacaacctcaggtcctcagacccaccagcccaaggaacatcacaccaattttaattcaggtaagcagcctctttttactctcttctccaacctccctcactatccctcaacctccttctcctttcaatcttggtgccacacttcaatctctcccttctcttaatttcaattcctttcattttctggtagagacaaaggagacacgttttatcagtggacccaaaactccggtgccggtcatggactagggaaggcagccttcccttggtgtttaatccttgcagggacacctctctgattattcacccaggtttcagaccacgcagggatgcctgccttggtccttcacccttagcggcaagtcccgcttttctgggggaggggcagggaccgcgacctcttatctctgcacccggatcccttatttccatgctccaacctcttatctctgtgccccaaccccttatttccatgcccttctctgcttttctggagggcaagaaccccccaccccttctccgtgtctctactctcttttctctgggcttgcctccttcactataggcaaccttccaccttccgttcctccttcttctcccttagcctgtgttcttaagaacttaaaacctcaactctcacctgacctaaaatctatgcgtcttattttcttctgcaatgctgcttgaccccaatacgaactcgacagtagttctaaatagccagaaaatggcactttcaatttttccatcctacaagatctaaataattcttgtcataaaataggcaaatggtctgaggtgcctgacatccaggcattcttttacacatcagtccttccctagtctctgttccgaatgcaacttttccgaaatcttccttctttccctcctgcctgtccactcagttccaaccccaaccgtcactgagtctttctaatcttccttttctacagacccatctgacctctcccctcctcgctaggctgagctaggtcccaattattcctcagcctccgctcctccaccctataatccttttatcacctcccctcctcacacccagtccggcttacagtttcattcctcgactagccctcccccacctgcccagcgatttactcttaaaaaggtggctggagctaaaggcatagtcaaagttaatgctcctttttcttcatcccagatcagatagcgtttaggctctttttcatcaaatataaaaacccagcccagttcatggcttgtttggcagcaaccctgagatgctttacagccctagaccctaaaaggtcaaaaggccgtctattctcaatatacattttattacccaatccactcctgacattaaataaaactccaaaaattaaattccagccctcaaaccccacaacaggacttaattaacctcaccttcaaggtgtacaataatagagtacaggcagccaagtagcaatgtatttctgagttgcaattccttgcctccactgtgagacaaaccccagccacatctccagcacacaagaactccaaatgcccgaaccgcagctgccaggggttcctccagaacctcctcccccaggagcttgctacatgtgccggaaatctggccactggtccaaggaatgcccacagcctgggattcctcctaagccacgtcccgtcggtgcgggaccccactgaaaatcggactgttcaactcacctggcagccactctcagagcccctggaactctggcccgaggctctctgactgactccttcccagatcttctcagcttagtggctgaagactgacgctgcctgattgcctcagaagccccctagaccatcatggacgccgagcttcgggtaactctcatagtggagggtaagtccatccactccttaatcaatacggaggctacccactccacattaccttcttttcaagggcctgtttcccttgcctccataactgttgtaggtattgacggccaggcttctaaacctcttaaaactccccaactctggtgccaacttagtcaatactcttttaagcactcctttttaattatccccacctgcccagttcccttattaggctgagacactttaactaaatcatctgcttccctgactattcctgggctacagccacaccttattgctgccttttcccccagttcaaagcctccttcacatcctccccttgtatctccccacctaagacacctctactccctccttagcgaccgatcatgcaccccttaccatctcattaaaacctaatcacccttacccctctcaatgccaatatcccatcccacagcacgctttaaaaggattaaagcctgttatcactcgcctgctacagcatggccttttaaggcctataaactctccttacaattccccctttttacttgtcctagaaccagacaagccttacaggttagttcaggatctgcgccctatcaaccaaattgttttgcctatccaccctgtggtgccaaatccatatactctcctatcctcaatacctccctccataacccattattctgttctggatctcaaacgtgctttctttactattcctttgcacccttcatcccagcctctctgctttcacttggactgaccctgacacccatcaggctcagcaaataacctgggctgtactgcaccaagtcttcacagacagcccccattacttcagtcaagcccaaatttcttcctcatctgttacctatctcagcataattcttcataaaaacacatgtgctctccctgccgatagtgtccgactgatctctcaaaccccaaccccttctacaaaacaacaactcctttccttcctaggcatgcttggatactttcgcctttggatacctggttttgccatcctaacaaaaccattatataaactcacaaaaggaaacctagctgaccccatagatcctaaatcctttccccactcctctttccattccttgaagacagctttagagactgcccccaccccagctctccctgactcatcccaacccttttcattacacacagctgaagtgcagggctgtgcagtcggaattctcacacaaggaccaggatcatgtcctgtagcctttttgtccaaacaacttgaccttactgttttaggctggccatcatgcctccgtgcagtggctgctgctgccctaatacttttagaggcccttaaaatcacaaactatgctcaactcactctctacagctctcataatttccaaaatctattttcttcctcacacctgacgcatatactttctgctccctgctccttcagctgtacttactatttgttgagtctcccacaattaccattgttcctggcctggacttcaatccggcctcccacattattccaggtaccacacctgaccctcatgactgcatctctctgatcaaactgacattcaccccatgtccccatatttccttttttcctgttcctcaccctgatcacacttagtttattgatggaagttccatcaggcctaatcaccacacaccatcaaaggcaggctatgctatagtacaagccactagcctgcctcttaaaacctctcatttcctttccatcatggaaatctatcctcaaggaaataacttctcagtgttccatctgctattctactgcttctcagggattattcggtccccctcccttccctacacatcaaactcgaggatttgcccccacccaggactggcaaattagctttactcaacatgccccgagtcagataactaaaatacctcttagtctaagtagacactttcactggataggtagaggcctttcctacagggtctgaggaggctaccgcagtcatttcttcccttctgtcagacataattcctcagtttagcctttccacatctataccgtctgataacagaccagcctttattagtctaatcagccaagcagtttttcagtctcttagtattcagtgaaacctttatatcccttacggtcctcagtctgcaggaaaggtagaacagattaatggtcttttaaaaacacacctcaccaagctcagccaccaacttaaaaaggactggacaatacttttaccactttcgcttctcagaattcaggcctgtcctcagaatgctacagggtacagcccatatgagctcctgtatagacactcctttttattaggccccagtcttattccagacaccagaccaacttggactgtgtcccaaaaaacttgtcatccctactatcttctgtctagtgatactcctattcaccgttctcaactactcatacatgccctgctcttgtttacactgccagtttacagtttctccaagccatcacagctgatatctcctggtgctatccccaaactgccgctcttaactcttgaagtaaataaataatctttgctggcaggactacgctgaacctccttaggcactctctaataagatgtcctgggtcctcccaattcttagacatttaattcctgtttttctccttctcttattccgtttagtttttcaattcatacaaaaccatatccaggccatcaccaataattctacacaacaaatgtttcttctaacaaccccacaatatcaccccttaccacaaaatcttccttcagcttaatctctcccactctaggttcccatgccgcccctaatcccgctggaagcagccctgagaaacatcgcccattatctctccataccatcccccaaaattttctctgtcccaacactttaccactatttcattttatttttcttattaatataagaagacaggaatgtcaggcctctgaggccgagttaagccatcatatcccctgtgacctgcatgtacacatcctgatggcctgttcctgccttaactgatgacattccaccgcaaaagaaatgaaaatggccgttcctgccttaactgatgacattatcttgtgaaattccttctcctggctcatcctggctcaaaagctcccctactgagcaccttatgacccccactcctgcctgccagagaacaaccccgctttttcctttacctacccaaatcctataaaacggccccacccctgtctcccttagctgactcttttcagactcagcccgcctgcacccaggtgaaattaatagccttgttgctcacacaaagcctgtttggtggtctcttcacagggacgtgcatgaaa

SEQ ID NO: 237 - DNA, 5815 bp, Homo sapiens
gtcaggcctctcagcccaagctaagccatcatatcccctgtgacctgcatgtacacatccagatggccagttcctgccttaactgatgacattccaccacaaaagaaatgaaaatggcctgttcctgccttaactgatggcattatcttgtgaaattccttctcctggctcatcctggctcaaaagctcccctactaagcaccttgtgacccccactcctgcctgccagagaactacccccctttcctttacctacccaaatcctatagaatggctccaccccgtctcccttcgctgactctctttttggactcagcccacctgcacccaggtgaaataaacagccttgttgctcacacaaagcttgtttggtggtcttttcacatggatgtgagtgaaatttggtgccatgactcagatcgggcaagctcccttaggagatcaatcccctgtcctcctgctctttgctccgtgagagagagccacctatgacttctggtcctcagaccaagcagcccaagcaagatctcaccaattttaaatctggtaagcagcctctttttactctcttctccaacctccctcactatccctcaacctctatctcctttcaatcttggtgccacacttcaatctctcccttctcttaatttcaattcctttcattttctggtagagacaaaggaggcacattttatccgtggacccaaaactctggcgctggtcatggactagggaaggcagccttcccttggtgtttaatcattgcagggacacctctctgattattcacccaggtttcagaggtgtcagaccacgcagggacgcctgtcttggtccttcacccttagcggcaagtcctgcttttctgggggaggggcaagaacccttcaacaccttctctttcacccttagtggcaagtcccgcttttctggaggaggggcaggaatcccgacctaatatctctgcaccccgatcccttatttccatgccccaacctcttatctctgtgccccaaccccatatttccacgccctgaccccttctctgcttttctggagggcaagaaccccccaccccttctctgtgtctctactctcttttctctgggcttgcctccttcactatgcacaagcttccaccttccattcctccttcttctcccttagcctgtgttcttaagaacttaaaacctcttcaattctcacctgacctaaaatctaagcatcttattttcttttgcaatgccgcttgaccccaatacaaactcgacagtagttccaaatagccggaaaatggcactttcaatttttccatcctacaagatctaaataattcttgtcaaaaaatggccaaatggtctgaggtgcctgacatccaggcattcttttatacatcggtccctccctagtctctgttcccaatgcaactcgtcccaaatcttccttctttccctcccacctgtctcctcagtcccaaccccaagcatcactgagtctttctaatcttccttttctacagacccatctgacctctcccctcctccccaggctgctcctcaccaggctgagctaggtcccaattcttcctcagcctccactcctccaccctataatccttttatcacctcccctcctcacaccaggtctggcttacagtttcattccctgactggccctccccaacctgcccagcaatttactcttaaaaagttggctggagttaaaggcatagtcaaagttagtggtcctttttctttatcccaaatcagatagcatttaggctctttttcatcaaatataaaaatccagcccagttcatgactcgtttggcagcaaccctgagatgctttacagccctagaccctaaaaggtcaaaaggccgtcttattctcaatatacattttattacccaatctgctcccgatattaaataaaactccaaaaattaaattccagccctcaaaccccacaacaggacttaattaacctcgccttcaaggtgtacaataatagagtagaggcagccaagtagcaacatatttctgagttgcaattccttgcctccactgtgagacaaaccccagccacatctccagcacacaagaacttccaaacacctaaaccgcagtggccaggtgttcctccagaacctcctcccccaggagcttgctacaagtgccagaaatctggccaccaagccaaggaatgcctgcagcccgggattcctcctaagctgtgtcccatctgtgggggaccccagtggaaatcagactgttcaactcacctggcagccactcccagagcccctggaactctggcccaaggctctctgctgactccttcccagatcttcttggcttagcggctgaagactgacactgcccgattgcctcggaagccctgtagaccatcacggacgccgagctttaggtaactctcacggtggagggtaagtccgtccccttctgaatcaatacggaggctacctactccacattactttcttttcaagggcctgtttcccttgcctccataactgttgtgggtattgacagccaggctgctaaacctcctaaaactccccaaatctggtgtcaacttagacaatactcttttaagcactcctttttagttatccccacctgcccagtttccttattaggctgagacactttaactaaattatctgcttccctgactattcctggagtacagctacatctcattgccgcccttcttcccaatccaaagcctcctttgcttcctcctcttgcatccccccaccttaacccacaagtataagatatctctactccctccttggtgaccaatcatgcaccccttaccatctcattaaaacctaatcacccttgccctgcttaatgccaatatcgcatcccacagcatgctttgaaaggattaaagcctgttatcactcgcctgctacagcgtggccttttaaagcctataaactctccttacaattcccccattttacctgtcctaaaaccagacaagccttacaagttagttcaggatctatgccttatcaaccaaattgttttgcctatccaccccatggtgctaaacccatatactctcctatacttgataactccctccacaatccattattctgttctggatctgaaacatgctttctttactattcctttgcacccttcatcccagcctctctttgctttcacctggactgaccctgacacccatcaagctcagcaaattacctaggctttactgctgcaaagcttcacagatagcccccattacttcagtcaagcccaaatttcttcctcatctgttacctatctcagcataattctcagaaaaacacatgcactctccctgctgatcgtgtccagctaatctcccaaaccccaatcccttctacaaaacaacaactcctttccttcctgggcatggttggatactttcacgtttggatacctggttttgccatcctaacaaaaccattatataaactcacaaaaggaaacctagctgaccccatagatcctaaatcctttccccactcctctttccattccttgaagacagctttagaggctgcccccatcctagctctccctgactcatcccaacccttttcattacacacagccgaagggcagggctgtgaagtcggaattcttacacaaggaccgggatcacgtcctgtagcctttttgtccaaataacttgaccttactgttttaggctggccatcatgtctccatgcagcggctgctgccgccctaatacttttagaggcccttaaaatcacaaaatatgctcaactcactctctacagctctcataatttccgaaatctattttcttcctcacacctgacacgtatactttctgctccctggctccttcagctgtactcactctttgttgagtctcccacaattaccattgttcctggctcggacttcaatgtggcctctcacattattcctgataccacacttgaccctcatgactgcatctctctgatccacctgacgttcaccccatttccccacatttccttcttccctgtttctcaccctgatcacacctggtttattgatggcagttccaccaggcctaatcgccacatgccagcaaaggcaggctatgatatagtacaagccactagcctgcctcttagaacctctcatttcctttccatcatggaaatctatcctcaaggaaatcacttctcagtgttccatctgctattctgctacttctcagggattattcaggccccctcccttccctacacatcaagctcagggatttgcccccacccaggactggcaaattagctttactcaacatgccccgagtcaggaaactaaaatacctcttggtctaggtagacactttcactggataggtacaggcctttcccacagggtctaagaaggccaccacggtcacttcttcccttctgtcagtcaaaattactcggtttggccttcccacctctaggcagtccaatagtagaccggcctttattcatcaaatcagccaagcagtttttcaggctcttggtattcagtgaaacctttatatcccttacagtcctcagtcttcaggaaaggtagaatggactaatggtcttttaaaaacacacctcaccaagctcagtcaccaacttaaaaaggactagacagtacttttacctctttcttttctcagaatttaggcctgtcctcagaatgctacagggtacagcccatttgagctcctgtatggacgctccattttattaagccccagtctcattccagacatcagaccaacttggactgtgccccaaaaacttgtcatccctactatcttctgtctagtcatactcctattcaccgttctcgactactcatatatgccctgctcttgtttacactgccggtttacaccgtttctccaagccatcacagctgatatctcctggtgctatccccagactgccactcttaactcttaaagtaaataaataatctttgctggcaaggctatgctgaacctccttaggcactctctaattagatgtcctaagtcctcccaattcttagtcctttaatacctgtttttctccttctcttattccctttagtttttcaatacatacaaaaccgtatccaggccatcaccaataattctaaatgacaaatatttcttctaacagtcccacaatgtcaccccttaccacaaaatcttccctcagcttaatctctcccactctaggttcccatgctacccctaatcccgctcaaagcagccctgagaaacatcgcccattatctctccatactatccccccaaattttcgccatcccaacactttaccactatttcgttttatttttctcattaatataagaagacaggaatgtcaggcctccgagcccaagctaagccatcatatcccctgtgacctgcacatccacatccagatggccggttcctgccttaactgatgacattccaccacaaaagaaatgaaaatggcctgttcttgccttaactgatggcattatcttgtgagattccttctcctggctcatcctggctcaaaagctcccctactgagcaccttgtgacccccactcctgcctgccagagaacaacccccctttttcctttacctacccaaaccctataaaacagccccacccctatctcccttcactgactctcttttcggacacagccctgcacccaggtgaaacaaacagccttgttgctcacacaaagcctgtttggtggcctcttcacagggacgcaagtgaaa

SEQ ID NO: 238 - DNA, 454 bp, Homo sapiens
gtcaggcctctgagcccaagccaagccatcgcatcccctgtgacttgcacgtatacgaccagatggcctgaagtaactgaaaaatcacaacagaaatgaatatgccctgccccaccttaactgatgacattccaccacaaaagaagtgtaaatggccagtccttgccttaagtgatgagattaccttgtgaaattccttctcccggctcatcctggctcaaaaagcacccccactgagcaccttgcgacccccactcctgcccgccagagaacaaaccccctttgactgtaattttcctttacctacccaaatcctataaaacggccccacccttatctcccttcgctgactctcttttcggactcagcctgcccgcctgcacccaggtgattaaaagctttattgctcacacagagcctgtttggtggtctcttcacagggacgcgcatgaaa

SEQ ID NO: 239 - DNA, 115 bp, Homo sapiens
tggagtaggtaggtagacagacatgagcagggcagtagagaccccccagccctccaggaatgtcaggcgaccatcaggtgatggtcagttggttgttaactgtttctctgaaata

SEQ ID NO: 240 - DNA, 5978 bp, Homo sapiens
gtcaggcctctgagcccaagctaagccatcatatcccctgtgacctgcaagtacacatccagatggccagttcctgccttaactgatgacattccaccacaaaagaagtgaaaatggcctgttcctgccttaactgatgacattatctggtgaaattccttctcctggctcatcctggctcaaaagctcccctactgagcaccttgtgacccccactcctgcccgccaaagaacaacccccctttgactgtaattttcctttatctacccaaatcttataaaacagcgccacccctatctcccttcgctgactctcttttcggactcagcccgcttgcacccaggtgaaataaacagccttgttgctcacacaaagcctgtttagcggtctcttcacacggacgcgagtgaaatttggtgccgtgactcagatcgggggaccccccttgggagatcaatcccctgtcctcctgctctttgttctgtgagaaagatccacctatgacctctggtcctcagaaaggaacatctcaccaattttaaatctggtaagcggcctctttttactctcttctccaacctctctcactatccctcaacctctttttcctttcaatcttggcgccacacttcaatctctcccttctcttaatttcagttcctttccttttctggtagagatgaaggagacgcgttttatctgtggacccaaaactctggcgctgttcacggactcgggaagacagtcttcgcttggtgtttaatcacacggggatgtctgcatgattattcacccacgtttcagaggtgtctgaccatgcagggacgcctgccttggtccttcaccgttagtggcaagtacagcttttctagggggcaagaaccccccatcccttctctccgtgtctctactctctcttttctctgggcttgcctccttcactatgggcaagcttctgccccccattgcccccttcttctcccttagcctgtgttcttaaaaacctaaaacctattcaacttacacctgacctaaaacctaaatgccttattttcttctgcgatgccgcttgaccccaatgcaaactcgacagtggttccaaatagccagaaaacggcacgttcaatttttccatcctacaagatctaaataattcttgtcataaaatgggcaaacggtctgagatgcctgacgtccagacattcttttacacatcggtccctccctagtctctgttcccagtacaactcatcccaaatcttccttctttccctcctgcctgtcccctcagtcccaaccccaagcgtcgctaagtctttctaatcttccttttctacagacccatctgacctctcccctcctcaccaggccaagctaggtccaaattcttcctcggcctccactcctccaccctataatccttttatcacctctcctccttacacccggtctggcttacagtttcgttccatgactagccctcccccacctgcccagcaatttcctcttaaaaaggtggctggagctaaaggcatagtcaaggttaatgctcctttttctttatcccaaatcagatagtgtttaggctctttttcagcaactataaaaacccagcccagttcatggctcgtttggcagcaaccctgagacactttacagccctggaccctaaaaggtcaaaaggccgtcttattctcaaaatacattttattacccaatctgctctggacattaaataaaactccaaaaattaaattccagccctcaaaccccacaacaggacttcattaaccgtgccttcaaggtgtacaataatagagtagaggcagccaagtagcaacatatttctgagttgcaattccttgcctccactgtgagacaaaccccagccacatctccagcacacaagaacttccaaatgcctaaaccgcagtgaccaggagttcctccaggcctgcctcccccaggagcttgctacaagtgccagaaatctggccaccaggccaaggaatgcccgcagcccaggattcctcctaagccgcgtctcatctgtgcgggactccactgaaaatcggactgttcaactcacctggcagccactcccagagcccctggaactctggcccaaggctctctgactgactccttcccagatcttctcagcttagcagctgaagactgacactgccaaatcgccttggaagccccctagaccatcatggatgccgagatttgggtaactctcacagtggagggtaagtccttccccttcttaatcaatatggaggctacccactccacattaccttcttttcaagggcctgtttcccttgcctccataactgttgtagatattgacggccaggcttctaaacctcttaaaactccccaactctggtgccaactttgacaatactcttttaagcactcctttttaattgtccccacctgtccagttcccttattaggctgagacactttaactaaattatctgcttccctgactattcctggactacagctgaatctcattgccgcccttcttcccaatccaaagcctcctttgcgtcctcctcttgtatccccccaccttaacccacaagtataagatacctctactccctccttggtgaccgatcatgcaccccttaccatctcattaaaacctaatcacccttagcctgctcaatgccaatatcccatcccacagcactctttaaaatgattaaagcctgttatcactcacctgttacagcatggccttttaaagcctataaactctccttataattcccccattttacctgtcctagaaccagacaagccttacaggttagttcaggatctgcgccttatcaatgaaattgttttgcctatccaccctgtggtgccaaacccatatactctcctatcctcaatacctccctccacagcccattattctgttctggatctcaaacatgctttctttactatccctttgcacccttcatcccagcctctcttcgctttcacttagactgaccctgacacccattaggctcagcaaattacctgggctgtactgccacagggcttcacagacagcccccattacttcagtcaagtccaaatttcatcctcatctgttacctatctcggcataattctcataaaaacacacatgctctccctgctgatcatgtctgactaatctcccaaacctcaatcccttacaaaacaacaactcctttccttcctaggcatggttagtgaggtcagaattcttacacaagagccaggaccgcaccctgtagcctttctgtccaaacaacttgaccttactgttttagcctagccctcatgtctgcgtgcagcggctgccgctgctttaatacttttagaggccctcaaaatcacaaactatgctcaactcactctctacagttctcataacttccaaaatctattttcttcctcacacctgaggcatatactttctgctccctggctccttcagctgtgctcactctttgttgagtgtcccacaattaccactgttcctggcatggacttcaatccagcctcccacattattctggataccacacctgaccctcatgactgtatctctctgatccacctaacattcaccccatttccccatatttccttctttcctgttcctcaccctgatcacatttggtttattgatggcagttccaccaggcctaatcgccactcaccagcaaaggcaggctatgctatagtagcttccacatctatcatcaaggctaccactctgcccacccccccccactacctctcagaaagccgaactagttgccttaactcaagccctcactcttgcaaaaggacgacacgtcaatatttatactgactctaaatatgccttccatatcatacaccaccatgtggtcacatgggctgaaagaggtttcctcactacgcaagggtcctccatcattaatgcctctaataaaaactctgctcaaggcggctttacttccaaaggaagctggagtcattcactgcaaaggccatcaaaaggcgtcagatcccattgctctaggcaacgcttatgctgataaggtggctagacaagcagctagctctccaacttctgtccctcacggccagtttttctccttcacatcagtcattcccacctactcccctgctgaaacttccacctatcagtctcttcccacacaaggcaaatggttcttagaccaaggaaaatatctccttgcagcctcacagtcccattctattctgttgtcatttcataacctcttccacataggttacaagctgctaccctgtctcttagaatctctcatttcctttccatcctggaaatctatcctccaggaaatcacttctcagtgttccatctgctattctactaccccttggggattgttcaggcctcctcccttccctacacatcaagcccggggatttgcccctgcccaggactggcaaattgactttactcacatgccccaagtcagaaaattaaaatacctcttagcctgggtagccatttcactggatgggtagaggcctttcctacagggtccgagaaggccactgcagtcatttcttcccttctgtcagacataattcctcagtttagccttcccacctcaatacagtctgataacagacgagcctttattagtcaaatcagccaagcagtttttcaggctcttagtattcagtgaaacctttatatcccttacggtcctccgtcttcaggaaaggtagaacagactaatggtcttttaaaaacacacctcaccaagctcagccaccaacttaaaaaggactggacaatacttttaccactttcccttctcagaattcaggcctgtcctcggaatgctacagggtacagcccatttgagctcctgtatggacgctcctttttattaggccccagtctcattccagacaccagaccaacttggactgtgccccaaaaaacttgtcatccctactatcttctgtctagttatactcctattcaccattctcaactactcatacatgccctgctcttgtttacgctgccggtttacactgtttttccaagccatcacagctgatatctcctggtgctatccccaaactgccgctcttaacttttgaagtaaataaataatctttgctggcaggactatgctgaatctccttaggcactctctaattagatgtcctaggtcctcccaattcttagacctttaatacctgtttttctccttctcttattccatttagtttttcaattcatacaaaaccatatccaggccatcaccaataattctaaatgacaaatgtttcttctaacaaccgcacaatatcaccctttaccacaaaatcttccttcagcttaatatctcccactctaggttcccatgccgccctaatcccgctcgaagcagccctgagaaacatcgcccattatctctccataccacctccaaaacttttcaccatcccaacactttaccaccatttcattttatttttcttattaatataagaagacaggaatgtcaggcctctgagcccaagctaaactatcatatcccctgtgacctgcacgtacacatccagatggccagttcctgccttaactgatgacattccaccacaaaagaagtgaaaatggcctgttcctgccttaacagatgacattatctggtgaaattccttctcctggctcatcctggctcaaaagctcccccactgagcaccttgtgacccccccactcctgcccgccagagaacaacccccctttgactgtaattttcctttacctacccaaatcttataaaacagccccacccctatctcccttcgctgactctcttttcagactcagcctgcctgcacccaggtgaaataaacagcctcgttgctcacacaaagcctgtttggtgtctcttcacacggacgtgagtgaaa

SEQ ID NO: 241 - DNA, 629 bp, Homo sapiens
caacagcaacgagcttttcatgagtcaaaaagaaaaactcatgtcagccccagccccgaggctacctgacctgacaaaactctttacactctatgtgtcagaaagagaaaaaatagcagttggagttttaacccagaccgtagagccctggccaaggccagtggcctatctctcaaaacaactagacggggtttccaaaggctgcccccctgtccaagggccctggcagcaacggccctgttagcacaagaagcagataagctaactcttaggcaaaacctaaagtccccccatgctgtggtgactttaataaataccaaaggacatcattagctaatgaattctagactaactagataccaaagcttgctctgtgaaaatccccacataaccactgaagtttgcaaaaccctaaaccctgccaccttgctcccagtatcagagagctcagtgaaacttaactgtgtagaagtgttggactcagtttattctagggggcccaaccaccgagaccatctttaaacatcagtagactcgagctgtacgtggacgggagcagcttcgccaacccctgcaaagtgactctgaagaagacgacaagccctgctccagtcacacccggaagctga

SEQ ID NO: 242 - DNA, 5659 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacactgtcttgtgaaattccttctcctggctcatcctggctcaaaagctccaccactgagtaccttgtgacccccactcctgcccgccagagaacccccctttttcctttacctacccaaatcctataaaacggccccacaccatctcccttcactgactctcttttcggactcagctcgcctatacccaggtgattaaaagctttattgctcacacaaaacctgtttggtggtctgttcacatggacgttcatgaaatttggtgccatgactcggatcaggggacctcccttgggagatcaatcccctgtcctcctgttctttgctccgtgaaaaagatccacctatgacctcaggtcctcagacccaccagcccaaggaacatctcaccaattttaaattgggtaagcggcctctttgtactctcttctccaacctccctcactatccttcaacctccttcacctttcaatcttggcgccacacttcaatctctcccttcttttaatttcaattcctttggttttctggtagagacaaaggagacacgttttatccgtggacccaaaactccagcgccggtcaccaactgggaaggcagccttcccttggtgtttaatcatttcagggacgcctctgtgattattcacccacgtttcagaggtgtcagaccacgcagggacacctgccttggtccttcacccttagcggcaagtcctgcttttctgtggaaggggcaagtaccccaaccccttctctccatgtctctaccccttctccgcctttcttgggggccagaaagccccaaccccttctccttcacccttagcggcaagtcccacttttctgggggaggggcaaataccgcaacctcgtatctctgtgcccctatcccttatttccgtgccccaacctcttatatctctgcaccccgatcccttatttccgcgccccaacctcttatatctccatgccccaatcccttatttctgcaccctgacctcctttctctgtgccccggcccctttcccgcttttctggagggtaagaacccccaaaccccttccctccctgtctctactctctcttttctctgggcttgcctccttcactatgggtaaacttccaccctccattcctccttcttctcccttagcctgtgttcttaagaacttaaaacttcttcaactctcacctgacctaaaatctaagcatcttattttcttctgcaatgctgcttgaccccaataaaaactcgacagtagttccaaatagccagaaaatggcactttcaatttttccatcctgcaagatctaaataattattgtcgtaaaatgggcaaacggtctgaggtgcctgacgtcccggcatcttttacacattggtccctccctagtctctgtgcccagggcaactcgtcccaaatcttccttctttccctcccgcctgtcccctcagtcccaaccccaagcgtatctgagtctttctaatcttccttttctacagacccatatgacctctcccctcctccccaggctgctcctcgccaggccaagctaggtcctaattcttcctcagcctcagctcctccaccctatgatctttttgtcacctcccctcctcactcccggtccggttcataatttcattccgtgagtaggcctccctcacctgcccagcaatttcctcttaaaaaggtggctgaagctaaaggcatagtcaaggttaatgctcctttttctttatcagacctctcccaaatcagtgagcatttaggctctttcatcaaatatgaaaaacccagcccaattcatggctcattcggcagcaaccctgagacgctttacagccctagaccctaaaaggtcaaaaggccatcttattctcaatatacatttcattacccaatctgctcccaacattaaataaaactccaaaaattaaattccagccctccaaccccacacaggatttaattatcttgccttcagggtgtacaataatagaaaaaagttgcaattccttgcctccactgtgagacaaaccgcagccacatctccagcacacaagaacttccaaatgcctgaacctcagtgaccaggcgttcctccagaacctcctcccccaggagcttgctacaagtgccagaaatctgaccaccaggccaaggaatgcctgcagcccaggattcctcctaagccatgtcccatctgtgcaggaccccactggaaatcggactgttcaactcacctggcagccacttccagagtccctggaactctggcccaaggctctctgactgactccttcccagatcttcttggcttagcagctgaagactgacactgcctgattgcctcagaagcctacaggaccatcacagatgctctaggtaactctcacagtggaaggtaagtccatccccttcttaatacggaggctactcactccacattaccttattttcaagggcctgtttcccttgcttccataactattgtgtgtattgacggccaggcttctaaaccgcttaaaattccccaactctggtgccaatttagacaatactcttttaagcactcctttttagttatccccacctgcccatttcccttatcaggccgagacactttaactaaattatctgcttccctgaccattcctaggctacagccacacatcattgctgccttttcccccagttcaaagccttctttacatcctccccttgtatctccctatcttaacccacaagtataagacacctctactccctccttagcgacagatcatgcaccccttaccatcccattaaaacctaatcactcttaccccgctcaatgccaatatcccatctcacagcatgctttgaaaggattaaagcctgttatcactggcctgttacagcatggccttttaaatcctataaactcttcttaccattcccccattttacctgtcctaaaaccagacaaggcttataggttagttcagaatctgccccttatcaaccaaattgttttgcctatccaccccgtggtgccaaacccatatactctcctatcctcaatacctcccttcacaacccattattctgttctagatctcaaacatgctttctttactattcctttgcacccttcatcccagcctctcttcgctttcacttggactgaccctgacacccattaggctcagcaagttacctgggctgtactgccacaaatcttcgcagatagcccccattacttcagtcaagcccaaatttcatcctcatctgttacctatctcggcataattctcataaaaacacacgtgctctccctgctgatagcgtccgattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcctagccctcatgtctgcgtgcagcggctgccgctgctttaatacttttagaggccctaaaaatcacacactatgctcaactcactctctacgtttctcataacttccaaaatctattttcttcctcatacctgatgcatatactttctgctccccagctccttcagctgtactcactctttgttaagtcgcacaattaccattgttcctggcccggacttcaatccggcctcccacattattctggataacacacctgaccctcatgactgtatctctctgatccacctgacattcaccccatttccccatattttcctctttcctgtacctcaccctgatcatgcttgatttattgatggcagttccaccaggcctaatagccacacaccagcaaaggcaggcttatgctatagtacaagccactagcccgcctcttagaacctctcattttctttccatcctggaaatctatcctcaagaaaataacttctcagtgttccatctgctattctactactcctcagggattattcaggccccctcccttccccacacatcaagctcgaggatttgcccccacccaggactggcaaattagctttactcaacatgccctgagtcaggaaactaaaatacctcttagtctaggtagatactttcactggataggtagaggcctttcctacagggtctgagaaggccactgcagtcatttattccgttctgtcagacataattcctcagtttagccttcccacctctatacagtctgataacagacgagcctttattagttaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactggacaatacttttaccactttcgcttctcagaattcaggcctgtcctcggactgctacaaggtatagcccatttgagctcctttttgttaggccccagtctcattccagacaccagaccaacttggactgtgccccagaaaacttgtcatccctactatcttctgtctagcctagtcatactcctattcactgttctcaactattcatacatgccctgctcttgtttacgctgccagtttacactgtttctccaagccagcacagctgatatctcctggtgctatccccaaaccgccactcttaactcttaaagtaaataaataatctttactggcaaggctatgccgaacctccttaggcactctgtaattagatgtcctaggtcctcccaattcttagtcctttaatacctgtttttctccttctcttattccgtttagtttttcaattcatacaaaactgtatccaggccatcaccaataattctaaatgacaaatgttacttctaacaaccccacaatatcacctcttaccacaaaatcttccttcagcttaatctctcccgctctaggttcccatgccacccctaatcccgctggaagcagccctgagaaacatcgcccattctctctccataccacccccaaaaatttccaccgtcccaacactttaccactgtttcattttatttttcttattaatataagaagacaggaatgtcaggcctctgagcccaagctaagccatcatatcccctgtgccctgccttaactgatgacattccaccacaaaagaagtgaaaacggcctgttcctgccttaactgatgacattgtcttgtgaaattccttctcctggttcatcctggctcaaaagctcccccactgagtaccttgtgacccccactcctgcccaccagagaacaacccccctttttcctttacctacccaaatcctataaaacagcccaaccccatctcccttatctgactctcttttcggactcagccctcctgcactcaggtgattaaaactttattgctcacacaaagcctgtttggtggtgtcttcacacggacacgaatgaaa

SEQ ID NO: 243 - DNA, 807 bp, Homo sapiens
tgactctcttttgggactcagcccgcctgcacccaggtgaaataaacagccctgttgctcacacaaagcctgtttggtggtctcttcacatggacgcgcatgaaagttggtgccgtgacttggatcgggggacctccctttggagatcaatcccctgtcctcctgctctttgctccgtgagaaagatccacctacgacctctggtcttcagactaaccagcccaaggaacatctcactaattttaaatctggtaagcggccttttttttactctcttctccaacctctctcactatccctcaacctctttcaactcacacctaacctaaaacctaaatgccttattttcttccgcaatgccacttgaccccaatagaaactcgacagtggttccaaatagccagaaaacggcactttcaatttttccatcctacaagatctaaataattcttgttgtaaaatgggcaaatggtctgagatgcctgacatctaggcattcttttacacatccgtccctccctagtctctgttcccaatgaaactcatcccaaatcttccttgtttccctcccgcctgtcccctcagtcccaaccccaagcgttgctgagtctttctaaccttccttttctacaccttgtgacccccacccctgccagccagagaacaacacccccgctttgacggtaattttcctttacctacccaaatcttataaaacggccccacccctatctcccttcgctgactcttttcagactcagcccgcctgcacccacgtgaaataaacagccttgttgctcacaaaaa

SEQ ID NO: 244 - DNA, 5899 bp, Homo sapiens
gtcaggcctctgagcccaagccaagccatcgcatcccctgtgacttgcacgtatacatccagatggcctgaagtaactgaagatccacaaaagaagtaaaaatagccttaacagatgacattccaccattgtgatttgttcctgccccaccctaactgatcaatgtactttgtaatctcccccacccttaagaaggttctttgtaattctccccacccttgacaatgtactttgtgagatccaccctgcccacaaaacattgctcttaacttcactgcctatcccaaaacctataagaactaatgataatccaccaccctttgctgactctcttttcggactcagcccgcctgcacccaggtgaaataaacagccatgttgttcacacaaagcctgtttggtggtctcttcacacggatgcacatgaaatttggtgccgtgactcggatcgggggacctcccttgggagatcaataccccgtcctcctgctctttgctccgtgagaaagatccacctacgacctcaggtcctaagaccgaccagcccaagaaacatctcaccaatttcaaatccagtaagcggcctctttttactctcttctccaacttccctcactatccctcaacctctttcttctttcaatcttggcgctacacttcaatctctcccttctcttaatttcaattcctttaattttctggtagagacaaaagagacatgttttatccgtggacccaaaactccagcgcctgtcatggactgggaaggcagccttccctttgtgtttaatcattgcagggatgcctctctgattatacacccatgtttcaagggtgtcagaccacgcagggacacttgccttggtccttcacccttagcggcaagtcccgcttttcttgggaaggggcaagtaccccaatcccttctctccttgtctctaccccttctctgcttctctggggaaggggcaagtaccccaaccccttctctccttgtctctaccccttctctgcttttctggggaaggggcaagtacccctcaacccccttctccttcacccttagcggcaagtcccgctttcctagagggcaagaacccccccaatcgcttatttctgcaccccaacctcttatctctgtgctccaatcccttatttccacaccctgaccttttatctctgtgccccaatcccttatttccatgccccaaccccttctctgcttttctggagggcaagaaccccccaccccttctccgtgtctctactcttttctctgggcttgcctccttcactatgggtaagcttccaccttccattcctccttcttctcccctagcctgtgttctcaaaaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgttgtaaaataggaaaacggtctgaggtgcctgacatccaggcattcttttacacatcagtcccttcctagtctctgtgcccagtgcaactcatcccaaatctttcttctttccctcctgcctgtcccctcagtcccaaccccaagcgtcactgagtctttctaatcttccttttctacagacccatctgacctctcccctcctcgccaggccgagctaggtcccaattcttcctcagcctccgctcctccaccctataatctttttatcacctcccctcctcacacctggtccggcttgcagttttgttccatgactagccctcccccacctgcccagcaatttaatcttaaaaagccaaaggcatagtcaaggttaatgctcctttttctttatcccaaatcagatagcgtttaggctctttttcatcaaatataaaaatccagctcagttcatgacttgtttggcagcaaccctgagatgctttacagccctagaccctaaaaggtcaaaaggccatcttattctcaatatacattgtattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacgcctgaactgcagtggccaggcgttcctccagaacctcctcccacaggagcttgctacacgtgccggaaatccggccactgggccaaggaatgcccgcagcccaggattcctcctaagccgcgtcccatctgtgtgggaccccactgaaaatcagactgttcaactcacctggcagccactcccagagcccctggaactctggcccaaggctctctgactgactccttctcagatcttctcggcttagtggctgaagactgacactgcccgatcgcctcggaagccccctaaaccatcacggatgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctacttccctgactattcctggactacagctatatctcattgccacccttcttcccaatccaaagcctcctttgcatcctcctcttgtatccccccaccttaacccacaaatatgagatacctctactccctccttggcgactgatcatgcaccccttaccatctcattaaaacctaatcacccttaccccactcaacgccaatatcccatcccacagcatgctttaaaaagattaaagcctgttatcactcgcttgctacagcatggccttttaaagcctataaactttccttacaattcccccattttacctgtcctaaaaccagacaagccttacaagttagttcaggatctgctccttatcaaccaaattgttttgcctatccaccccatggtgccaaacccatatactctcctatcctcaatacctgcctctacaacccattattctgttctagatctcaaacatgctttctttaccattcctttgcacccttaatcccagcctctcttcactttcacttggactgaccctgacacccatcaagctcagcaaattacctaggctgtacggctgcaaagcttcacagacagcccccattacttcaatcaagcccaaatttcttcctcatctgttacctatcttggcataattctcataaaaacacacgtgctctccctgccaatcgtgtctgactgatctctcaaaccccagcaccttctacaaaacaacaactcctttccttcctaggcatggttagtgcagtcagaattcttacacaagagccaggaccgcaccctgtagcctttctgtccaaacaacttgaccttactgttttagcctagccctcatgtctgcgtgcagtggctgccgctgcattaatacttttagaggccctcaaaatcacaaactatgctcaactcactctctacagttctcataacttccaaaatctattttcttcctcatacctgacgcatatactttctgcttcccagctccttcagctgtactcactctttgttaagtcccacaattaccattgttcctggcccagacttcaatctggcctcccacattattcctgataccacacctgacccccatgactgtatctctctgatccacctgatattcaccccatttccccatatttccttctttcctgttcctcaccctgatcacgcttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactacccctcagggattgttcaggcctcctccctttcctacacatcaagctcgaggatttgcccctgcccaggactggcaaattgactttactcatatgcctcgagtcagaaaactaaaatatctgttagtctgggtagacaccttgactggatgggtagaggccttccccacagggtctgagaaggccaccacagtcatttcttcccttctgtcggacataattcctcggtttggccttcccacctctatacagtctgataacggaccagcgtttactagccaaattacccaagcagtttctcaggctcttggtattcagtggaaccttcatatcccttaccatcctcaatcttcaggaaaggtggaacggactaatggtcttttaaaggcacacctcaccaagctcagcctccaacttaaaaaggattggacagtacttctacctcttgctcttctcagaatcagagcctgtcctccagatgctacagggtacagtccatttgaacttttatagggatgcactttcttgcttggccctaacctcatccagacaccagccctctaggcgactatcttccagtcctccagcaggctagacagcaaattcgccaggctgctaatcttctcttgcctactccagatccccagccatatgaagacaccctagctggatgatcagttcttgttaagaatctgacccctcaaactctacaacctcgatggaccggaccctacttagtcatctatagtaccccgactgccatccgcctgcaggatcctccccactggtttcaccattccagaataaagctgtgtccattggacagctagcctaatccctcctcttcctcctggaagtcgcaagtactttcccctacttcccttaaactcactcgtatttctgaagaacagtaataacacttatgagcctaatacatcccttcattctattagatcttttcgtccttaccctactttttgcaacagggctttacgaagccacccccaccacttagactgtgccccaaaaaaacttgtcatccctactatcttttttctagtcatactcctattcaccgttctcaactactcatacatgccctgctcttgtttacactgccggtttacactgtttctccaagccatcacagctgatatctcctggtgctatacccaaactgccactctaaactcttgaagtaaataaataatctttgctggcaggactatgctgaatctccttaggtactctctaatcagatgtcctaggtcctcccaattcttagaccttttatacctgtttttctccttctcttattccatttagtttctcaattcatccaaaaccgtatccaggccatcgccaatcattctatacaacaaatgtttcttcttacatccccacaatatcaccccttaccacaagacctcccttcagcttaatctctcccattctaggtttccacgccaccccaatcccgcctgaagcagccctgagaaacatctcccattctctctccataccaccccccaaaaatgttcaccgccccaacacttcaacactattttgttttatttttcttattaatataagaaggcaggaatgtcacgcctctgagcccaagccaagccatcgcatcccctgtgtgacttgcacgtatacatccagatggcctgaagtaactgaagatccacaaaagaagtaaaaatagccttaactgatgacattccaccat

SEQ ID NO: 245 - DNA, 475 bp, Homo sapiens
ttcggtaagggtggtgagaaaaattgtagaaagaagcaaaccttcttagaaggctgggaagttttacaaaagcttcagaaaaggatttggccgaaagcagccagattctcttatccggtgcctgaaagcttaggttagataacaaggggatgtaaagaaactgatgtagataagttagtttacttaggcctcggaacctggactttaataaatcgaggcgcaggactgctctctccggagatgaggtgggggtgggggggtgatgaccatgttaattacccacaatgactcaaggcctttgtcattaaatctgtactaaatagttgcccgcagcaccagcttgtcagggccgaggctgctacaactctttctgtaggcagtccactcccctagcccgctctttcactggatatctgtgtcggagtccatttttttcatctatcgctcggtcgcagtctgcagtttggacctggca

SEQ ID NO: 246 - DNA, 3863 bp, Homo sapiens
gtcaggcctctgagctcaagctaagccatcatatcccctgtgacctgcacatatatatccagatggcctgaagcaagtgaagaatcacaaaagaagtggaaatggctggttcctgacttaactgatgacattaccttgtgaaattccttctcctggctcagctactcctccactgagcaccttgtgacccccgcccctgcccgccagagaacaacccccttttgactgtaattttcctttacctacccaaatcttataaaacggccccaccctatctccctttgctgactctcttttcggactcagcctgcctgcacccaggtgaaataaacagccttgttgctcacacaaagcctgttggtggtctcttcacacagacgcgtgtgacatttggtgccgaaacccaggacaggaggactccttcgggagaccggtcccctgtcctcaccctcactccatgaggagatccacctgtgaactggggtcgtcagaccaaacaacccaaggaacatctcaccaatttcaaatcaggtaagtggtcttttcactctcttctccagcctctctcgctacccttcaatctccctgtccttccaattccagttctttttcctctctagtagagacaaaggagacacattttatccgtggacccaaaactccggcgctggtcatggactcgggaagacagtcttcccttggtgtttaatccctgcggggacgcctgcctgattattcacccacatttcactggtgtctgatcaccacggggacacctccttggtcattcacccacattcccttggtggcaagtcaattgcggggttgcctgctttggctgctcacccacactgcagcccagggctgctcaccacccccttctccgtgtctctaccctctcttttctctgggcttgcctccttcactatgggcaaccttccaccctccattcccccttcttctcccttagcctgtgttctcagaaacttaaaacctcttcaactctcacctgacctaaaacctaagcatcttattttcttctgcaacaccgcttgggccccaatacaaactcgataatggttctaaattgccagaaaatagcacttttgatttctccattttacaagacctggatgaattttgtcaaaaaatgggcgaatgggtctgaggtgctcgacgtccaggcattcttttacacattggtccctccctagtctctgctcctaatgcgactcacccgatatccttcttctttctctcctgtctgttccttaagtctgcatcccaagctctgagtcctttgaatcctccttttctacagacccatctgacctctcccctcctccccaggctgttcctcgccaggccgagccaggtcccaattcttcctcagcctccactcccataccctataatccttctgtcccctcccctgctcacacctggtccagcttacagtttcattccgaaactagccctcccccacctgcccaataatttcctcttaaagagatggctggagctgtaggcatagtcaaggttaatgctcctttttctttatctgacctctcccaaatcagttagcgtttaggctctttttcatcaaatataaaaacccagcccagttcatggctcatttggcagcaaccctgagacactttacagccctaggccctgaaaggtcagaaggccgtcttattctcaatgtgcattttattacccaatcagctcccgacatttaaaaaaagctcaaaaaattagatcctggccctcaaaccccacaacaggacttaattcacctcgccttcaaggtgtacaataatagagaagagttacaattacttgactctgttgtgagacaaaacccagccacatctccagcacacaaaaacttcaaaatgcctaagccacagtggtcaagcattcctacaggacctcctccatcaggatcttgcttcaagtgccagaaatctggccactgggccaaggaatgcccacagcccaggattcctcccaagccatgtgccatctgtgtgggaccccactggaaatcagactggccaactcacccggcagccactcccagagcccctggaaccctggcccaaggccctctgactgactccttcccagatctccttggcttagtggctaaagactgatgctgcccaatcacctcagaagcctcgtggaccatcacagatactttggataactcttatagtggagggtaagtccgtccccttcttaattaaaatatggaggctacccactccacattactttcttttcaagggcatgtttcctttgcctccataactgttgtgggtattgatggccaggcttctaaacctcttaaaactccccaactctgatgccaacttggacaacattcttttatgcactcctttttagttatccccacctgcccagctcccttattaggttgagacactttaactaaattatctgcttccctgactattcctaggctatagccacacctcattgccgcccttttccctagttcaaagcctcctttgcatcctcctctcatatcccccccaccttaacccacaagtatgggacccctctactccctccgtggcaaccaatcacacgcccattactatcccattaaaacctaatcacccttaccctgctcaacaccaatatcccatcccacagcacactttacaaggattaaaactcattatcactcacctgttacagcatggccttttaaagcctataaactctccttaccatttcctattttacctgtccaaaaaccagacaagtcttacaagttagttcaggatccacactttatcaaccaaattgttttatctatccaccccgtggtgccaaacccacatactctcctatcctcaatacctccctccacaatccctccacaacccattattctgttctggatctcaaacatgctttctttactattcctttgcacccttcatcccagcctctcttcgctttcacttagactgaccctgacacccatcaggctcagcaaattacctgggctgtactgccgcaaggcttcatggacagcccccattacttcaatcaagcccaaatttcttcctcatcccttacctatctcggtataattcttcatgaaaacacacgtgctctccctgctgatagtgtccggctaatctcccaagccccaaccccttctacgaaacagctcctttccttcctaggcatggttaggtacttccacatttggatacctagttttaccatcctgactaaaccattatatgaactcacaaaagcaaacctagctgaccccatagatcctaaatcctttcaccactcctctttcccttccttaaaaacagccctaaaagctactctcacactagctctccctaactcatcccaacccttttcattacacacagccaaaatacagagctgtgtggtcaaaattcctacacaacagccaggaccatgccctgtactctttctgtccaaacaacttgcccttactgttttaggctggcccctacattattcctgataccacacctgacccccatgactgtatctctctgatccacctgacattcactccatttccccatatttccttcttttctgttcctcaccctgatcacacttggtttattgatggcaattccaccaggcctaatcgccactcaccagcaaaggcaggctatgctatagtatcttccacatctattattgaggctattgctcttccccgctccactatctctcagcaagccgaactcattgccttaactcaggccctcactcttgcaaaaggagtacgtgtcaatatttatactgactgtaaatatgccttc

SEQ ID NO: 247 - DNA, 5658 bp, Homo sapiens
gtcaggcctctgagcccaagctaagccatcatatcccctgtgacctgcacttacacttccagatggccagttcctgccttaactgatcacattccaccacaaaagaagtgaaaatggcctgttcctgcctttgctgatgacattaccttgtgaaattccttctcctggctcatcctggctcaaaagctcccctgctgagcaccttgtgacccccccgcccctgcccaccagagaacaaccccctttgactgtaattttcctttacctacccaaatcctataaaacagccccacccctatctcccttcgctgactctcctttcggactcagcccacctgcacccaggtgaaataaacagccttgttgctcacacaaatcctgtttggtggtctcttcacacggacgtgagtgaaattttggtgccgtgactcggattgggggacctcccttgggagatcaatcccctgtcctcctgctctttgctccgtgagaaagatccacctacgacctcgggtcctcagaccgatcaacccaaggaacatctcaccaattttaaattgggtaagcggcctctctttactctcttctccaacctctcactgtccctcaatctctttctcctttcaatcttggcgccacccttcaatctctcccttctcttaatttcaattcctttcattttctgatagagacaaaggagacacattttatctgtggacccaaaactctggcgccggtcacggactcgggaaggcagccttcccttggtgtttaatcactgcagggacacctctctgattattcacccacatttcactggtgtctgatcaccgtggggacgcctgccttggtcattcacccacattcccttggtggcaagtcagttgcggggactcctgctttggctgctcccccatgttgcagcccagggctgctccccacctcccttctctgtgtctttacccttctctttaaacttacctccttcaccatgggcaaccttccgccctccattcccccttcttctcccttagcctgtgttctcaagaacttaaaacctcttcaactctcgcctgacctaaaacttaaacgccttattttcttctgcaacactgcttggccccaatacaaactcgaaaatggttctaaatgtccagaaaatggcacttttgatttctccatcctacgagacctagataatttttgtcaaaaaatgggcaaatggtctgaagtgcctgacgtccaggcattcttttacacattgttctctccctagtctctgttcccaatgcgactcatccgaaatcctccttctttccctctcgcctgtgctctcagtcccaactccaagcgtcgccgagtctttctttcttttctacagacccatctgacctctcccctcctccccaggctgctcctcaccaggctgagctaggtcccaattcttctttagcctctgctcccccaccctataatccttttatcacctcccctcctcacacccggtccggcttacagtttcgttcctcgactagacctcccccacctgcccagcaatttcctcataaaaagttggctggagctaaaggcatagtcaaggttaataatgctcctttttctttatccgatctatcccaaatcagttagcgtttaggctctttttcatcgaatataaaaacccagctcagttcatggctcgcttggcagcaaccctgagatgctttacagccctagaccctgaaaggtcaaaaggccgtcttattctcaaaatacattttattacccaatccactcccggcattaaataaaactccaaaaattaaattccagccctcaaaccccacgacaggacttaattaacctcgccttcaaggtgtgtaataatagagtaaaggcagctaagtagcaatgtatttctgagttgcaattccttgcctccactgtgagacaaaccccagccacatctccagcacacaagaactccaaacgcccgaacggcagctgccaggggttcctccagaacctcctcccccaggagcttgctacaagtgccggaaatctggccactcggccaaggaaagcccacagcccggaattcctcctaagctgtgtcccatctgtgcgggaccccactggaaattggactgtccaacttgcccggcagccactcccagagcccctggaactctggcccaaggctctctgactccttcccagatcttctcggcttagcggctgaagactgacgctgaccgatcacctcagaagcctacaggatgatcacagaagctttaggtaactctcatagtggaggatggacttaagaagtccgtccccttcttaatcaatacggaggctacccactccatattaccttcttttcaagggcctgtttcccttgactccataactgttgtgggtattgaatgccaggcttctaaacatcttaaaactccccaactctggtgccaacttagacaatattattttaagcacttctttttagttatcctcacctgcccagttcccttattaggttgagacattttaactaaattacctgcttccctgactattcctgggctacagccacacctcattgccgccttttcccccagttcaaagcctccttcacatcctccccttgtatctccccacctcaatccataggtataagacacctttactccctccttggtgaccgattacgcaccccttaccatcccattaaaacctaatcacccttaccccactcaatgccaatatccgatcccacagcccactttaaaaagattaaagcctgttatcacttgcctgttacggcacggccttttaaactctccttacaattaccccattttacctgtccaaaaactggacaagtcttacaggttagttcagggtctacgccttatcaaccaaattgttttgcctatccaccccgtggtgccaaacccatatactctcctatcctcaatacctccctccacaacccattattctgttccagatctcaaacatgctttctttactattcctttgcacccttcatcccagcctctctttgctttcacttggactgaccctgacacccatcagactcagcaaattacctgggctgtactgcctcaaggcttcacagagagcaccccccccccattacttcagtcaagcccaaatttcttccccatctgttacctatctcggcataattctcacaaaaacacatgtgttctccctgctgatcgtgtccgactaatctcccaaatctcaatcccttctacaaaacaactcctttccttgctaggcatggttagtgcagtcagaattcttacacaagagccgggaccgtgccctgtagctttctgtccaaacaacttgaccttactgttttaccctagccctcatgtctgcgtgcagcggctgccactgctttaatacttttagaggccgtaaaaatcacatactatgctcaattcactctctacagttctcataacttccaaaatctattttcttcctcacacctgatgggtatactttctgctccctggcttcttcagctgtactcactctttgttgagtctcccacaattaccattgttcctggcccggacttaatctggcttcccacattattcctgatattacgcctgacccccatgactgtatcactctgatccacctgacattcaccccatttccccatatttccttctttcctgttcctcaccctgatcacgcttggtttattgatggcagttccaccaggcctaatcgccactcaccagcaaaggcaggctatgctgtagtacaagccgctagcccgcctctcagaacctctcatttcctttccatcatggaaatctatcctcaaggaaatcacttctcagtgttccagctgctattctactactcctcagggattattcaggacccccgcccctgccccccgcttccctacacatcaagcttggggatttgccctctcccaggactggcaaattgactttactcacatgctccgagtcaggaaactaaaatacctcttggtctgggtagacactttcactggatgggtagaggcctttcccacagggtctgagaaggtcaccacagtcatttcttctcttctgtcagacataattcctcggtttagccttcccacctctatacagtctgataatggacaggcctttattagtcaaatcacccaagcagtttctcaggctcttggtattcagtgaactgatggtctttttaaaacacatctcacaaagctcagctacaaacttaaaaaggacttgacaatacttttaccactttcccttctcagaattcgggcctgtcctcggaatgctacaagttacagcccatttgagcttctgtaatagactctcgttttattaggccccagtctcattccagacaccagaccaacttgaactgcgccccaaaaaacttgtcatccctactgtcttctgtctagtcatactcctattcaccattatcaactactcataaatgccctgctcttgtttacagtgcctgtttacactgtttctccaagccatcacagctgatatctcctggtgctatccccaaagcgccactcttttttttttttttgagatagagtctcgctctgtcacccaggctggagtgcagtggcgcgatctcagctcactgcaagctctgcctcccgggttcatgccattctcctgcctcagcctcccgagtagctgggactacaggcacatgccaccacgcccggctaattttttgtatttttagtagagatggggtttcactgcattagccaggatggtctcgatctcctgacctcgtgatccgcctgcctcagcctcccaaagtgctgggattacaggccactcccacttaaagtaaataaataatctttgctggcagggctatgctaaacctccttgggcactctctaattggatgtcctgggtcctcccaattcttagccctttaataccggtttttctccttctcttattcggaccttgtgtcttccatttagtttttcaattcatacaaaaccacatccaggccatcaccaatcattctatatgacaatgtttcttctcacaaccccacaatatcaccccttaccacaaaatcttccttcagcttaatctctcccactctaggttcccacgccacccccactcccgctcaaagcagccctgagaaacatcgacgattatctctccataccacgcccaccaaaatttttgctgccccaacacttcaacactattttatgttatttttcttattaatataagaagacaggaatgtcaggcctctgagcccaggctaagccatcatatcccctatgacctgcacgtacacatccagatggccggttcctgccttaactgatgacattccaccacaaaagaagtgaaaatggccagtccctgccttaactgatgacattaccttgtgaccccccactcctgcacaccagagaacaaccccctttgactgtaattttcctttacctacccaaattctataaaatagccccacccctatctcccttcgctgactctctttttggactcagcccgcctgcacccaggtgaaataaacagccttgttgctcacacaaagcctgtttggtgg

SEQ ID NO: 248 - DNA, 5347 bp, Homo sapiens
gactcggatcgggggacctcccttgggagatcaatcccctgtcctcctgttctttgctccgtgagaaagatccacctacgacctcaggtcctcagaccgaccagcccaaggaacatctcaccaattttaaatcgggtaagtggcctcttcttactcttctccaacctctctcactgtccctcaaccactttctcctttccactcttcaatctctcccttctcttaatttcaattcctttcattttctgggagagacaaaggagacacgttttatcagtggacccaaaactctggcactggtcacggactgggaaggcagccttcccttggtgtttaatcattgcagggacgcctctgattatacacccacgtttcaagggtgtcagaccacgcagggacgcctgccttggtccttcacccttagcagcaagtcccgcttttctggggaaggggcaagtacctcaaccccttctctccttgtctctaccccttctctgcttttccagggacagggcaagtaccccaaccccttctctccttgtctctaccccttctctgtttttctgggagaggggcaagtacccctcaaccccttctccttcactcttagcggcaagtcccgcttttctagaggaggggcaagtaccccaacctcatacctctgtgccccaatcccttatttctgcaccccaacctcttatctgtgtgccccaatcccttatttctgtgccccaaccccttatttctgcaccccatcccttatttccgtgccccgacctcttatctctgcgccccaacccattttcccacttttctggaaggtaagaacccccgaaccccttctctccatttctctactctctctttatgggcaaccttctaccctccattcctcctcctactcccttggcctgtgttctcaaaaacttaaaacctctttaacacctgacctaaaacctaaatgccttattttcttctgcaatgccgcttgaccccaatacaaacttgacagtagttccaaatagccagaaaatggcactttgaatttttccatcctgcaatatctaaataattcttgtcttaaaataggcaaacagtctgaggtgcctgacgtccaggcattcttttacacatcagtcccttcctagtctctgtgcccagtgcaactcgtcccaaatcttccttctttccctcccacctgtcccctcagttccaaccccaagcgtcactgagtctttctaatcttccttttctacagacccatctgacctctcccttcctccccaggctgctcctcgccaggccgagctaggtcccaattcttcctcagcctccgctcctccaccctataatcctttatcacctcccctcctcacacctggtccggcttagtttcgttccgtgactagccctccccctcccgcccagcaatttactcttaaaaaggtggctggagctaaaggcatagtcaaggttaatgctcctttttctttatcccaaatcagatagcgtttaggctctttttcatcaaatataaaaatccagcccagttcatggctcgtttggcagcaaccctgagacactttacagccctagaccctaaaaggtcaaaaggctgtcttattctcaaaatacattttattacccaatctgctcctgacattaaaactccaaaaattaaattccagccctcaaaccccacaacaggatttaattaacctcgccttcaaggtgtacaataatagaaaaaagttgcaattccttgcctccactgtgagacaaaccccagccacatctccagcgcacaagaacttccaaatgcctgaacggcagtggccaggcgttcctccagaacctcctcccacaggagcttgctacacatgccggaaatctggccactgggccaaggaatgcccgcagcccgggattcctcctaagccgcgtcccatctgtgtgggaccccactgaaaattggactgttcaactcacctggcagccactcccacagcccatggaactctggcccaaggctctttgactgactccttcccagatcttctcggcttagcagctgaagactgacactgcccgatctcctcggaagccccctagaccatcacggacaccgagcttcgggtaactctcacagtggaaggtaagcccgtccccttcttaatcaatacggaggctacccactgcacattacctttttttcaagggcctgtttcccttgcctccataactgttgtgggtattgatggccaggcttctaaacctcttaaaactccccaactctggtgccaacttagacaatactcttttaagcactcctttttagttatccccacctgcccagttcccttattaggctgagacactttaattatctgcttccctgactattcctggactacagctatatctcattgccgcccttcttcccaatccaaagcctcctttgcatcctcctcttgtatccccccaaccttaacccacaagtataagatacctctactccctcttaggcaaccgatcatgcaccccttaccatctcattaaaacctaatcacctttaccctactcaacgccaatattccatcccgcagcacactttaaaaagattaaagcctgttatcactcgcctgctacagcatggccttttaaagcctataaactctccttacaattcccccattttacctgtcctaaaaccagacaagccttacaagttagttcaggatctgcaccttatcaaccaaattgttttgcctatccacccggtggtgccaaacccatacactctcctatcctcaatacctgcctctacaacccattattctgttctagatctcaaacatgctttctttactattcctttgcaccctcaatcccagcctctcttcgctttcacttggactgaccctgacacccattaagctcagcaaattacctaggctgtactgccgcaaagcttcacagacagcccccattacttcaatcaagcccaaatttcttcctcatctgttacctatctcggcataattctcataaaaacacacgtgctcttcctgccaatcgtgtccgactgatctctcaaaccccagcaccttctacaaaacaacaacttctttccttcctaggcatggttagcacggtcagaattcttacacaagagccaggaccacaccctgtagcctttctgtccaaacaacttgaccttactgttttagcctagccctcacgtctgcatgcagcagctgccgctgctttaatacttttagaggccctcaaaatcacaaactatgctcaactcactctctacagttctcataacttccaaaatctattttcttcctcatacctgacgcatatactttctgctccccggctccttcagctgtagtcactctttaagtcccacaattaccattgttcctggcctggacttcaatctggcctcccatgttattcctgataccacacctgacccccatgactgtatctctctgatccacctgatattcaccccatttccccatatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactgctcctcagggattattcaggtcccctcccttccctacacatcaagctcgaggatttgccccacccaggactggcaaattagctttactcaacatgccctgagtcggataactaaaatacctcttagtctaggtagatactttcactggataggtagaggcctttcctacagggtctgagaaggccaccgcagtcatttcttccgttctgtcagacataattcctcagtttagccttcccacctcaatacagtctgataacagatgagcctttattagtcaaatcagccaagcagtttttcaggctcttagtattcagtgaaacctttatatcccttacggtcctccgtcttcaagaaaagtagaatggactaaaggtcttttaaaaacacacctcaccaagctcagccaccgaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgccccccaaaaaacttgtcatccctactatcttctgtctagtcatactcctattcaccgttctcaactactcatacatgccctgctcttgtttacactgccggtttacactgtttttccaagccatcacagctgatatctcctggtgctatccccaaactgccactcctaactcttgaagtaaataaataatctttgctggcaggactatgctgaatctccttaggcactctctaatcagatatcctgagtcgtcccaattcttagaacttttatacctgtttttctccttctgttattccatttagtttctcaattcatccaaaaccgtgtccaggccatcaccaatcattctatacgacaaacttttcttctaacatccccacaatatcaccccttaccacaagacctcccttcagcttaatctctcccactctaggttcccacgccgccccaatcccgcttgaagcagccctgagaaacatcgcccattctctctccgtaccaccccccaaaaattttcgctgccccaacacttcaacactattttgttttatttttcttattaatataagagggcaggaatgtcaggcctctgagcccaagccaagccatcgcatcccctgtgacttgcacgtataagcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaacacccccactgagcaccttgcgacccccactcctgcccgccagagaacaaaccccctttgactgtaattttcctttacctgcccaaatcctataaaacggccccactcttatctccctttgctgactctcttttcggactcagcccgcctgcacccaggtgaaataaacagccatgttgctcacacaaagcctgtttggtggtctcttcatacggacgcgcatgaaa

SEQ ID NO: 249 - DNA, 713 bp, Homo sapiens
tcaatccatcaagaccctttcacgtggaaccccttaaagctgtaagcccttaaacgggccaggaactctgtcttccttccgggagctcggctcttaagacgcgagtctgccgaagctcccagcggaataaaaaaaactcttccttctttaatccgctgtctgaggggttttgtccgctgctcatccatgctccatttctttgttccctgaccgggaatcgaacgcaggcagcagcggtgagagcaccgaatcctaagcactagaccaccaggggaacttagaaccttgtgggaaatagattgcgcaccattagaagtgggttggccatcagaaggaagcctggacaggtcccttgtttctaaggcgtggcacaaggtaactggtaaagatacctagaccagttcccatacatagacacttggtgacagctggtgctagaacccccacagtggctgagggcatgcagcagcaatactagtagcaaagggacagatagctaaggaaggatcccgctccactcacccagggaaatcaactcctgaagttctgttcgaccccacatcagaggatccattgcaggagatggcaccagagatcccagtggtgtcctccccttaacagggaaagaggctccccactcttgagcccacagtgcttgtgcctccacaagacaagcatatccctaggccacccagagtagacaagagaggagg

SEQ ID NO: 250 - DNA, 9521 bp, Homo sapiens
gtcatgcctctgagcccaagcctgcacatatacatccagatggcctgaaacaactgaagaatcacaaaagaagtgaaaatggtcaattcttgccttaactgatgacattaccttgtgaaattccttctcctggctcagaaggtcccccactgagcaccttgtgacccccgcccctgcccaccagagaacaacccctgccccacccctaactccctttgctgactctcttttccgactcagcctgcctgcacccaggtaattaaaaagctttattgctcacacaaagcctgtttggtgacctcttcacatggatgtgcgtgacatttggtgccatgacttggatcgggggacatcccttgggatatcaatcccctgtcctcctgctctttgctccatgagaaagagccacctacaacctctggtcctcagaccaatcagcccaaggaacatctcaccaattttaaatcaggtaagcggcctctttctattctcttctctaacctctctcactatccctcaacctctttctcctttcaattttggtgctacccttcaatctctcccttcccttaatttcagttcctttcactttctggtagagacagaggagatgtgttttatccgtgaacccaaaactccagcaccggtcacggactcaggaagacagtcttcccttagtgtttaatcactgcagggatgcctgcctgattattcacccacatttcagcggtgtctgattaccatggggatgcctgccttgatccttcaccttggtggcaagcaccacctcccaagggggcaagtacccccccccccccacctcttctctctttgtctctaccctctctttgctccttcactatgggcaatcttccaccttccattcctccttcttctcccttagcctgtgttctcaagaacttaaaacctcttcaactcacacctgacctaaaacctaagtgccttatttttttctgcaataacacttgaccccaatacaaactcgacaatggttccaaatagccagaaaatggcactttcaatttctccatcctacaaaatctagataattcttatggaaaaatgggcaaatggtctgaggtgcctgacgtccaggtattcttttacacatcagtccttccctaatctctgctcccaatgcaactcatcccaaatctttcttctttctcttctgtctgttccttcagtctccaccccaagctctgagtcctttgaattctccttttctatggactcatctgacctctcccctcctccccaggctgctccttgccagactgagccaggtcccaattcctccttggcctccaccctataatccttctatcacctcccttcctaacacctggtccaacttacagtttcattctgcaactagccctcccccacctgcccaaaaatttcctcttaaagaagtggctgcatctaaaggcatagtcaaggttaatgctcctttttttttatctgacctctccctatccgacctctcccaaatcagttagcgtttaggcttttcttcatcaaatataaaagctcagcccagtccatggcttgtttggcaacaacccttagatgctttacagccttggacccagagaggccagaaggggccatcttattctcaatatgcattttattacccaatccactcccgacattaaaaaaagctccaaaaattaaattccggccctcaaaccccacagcaagacttaattaaccttgccttcaaggtgtgcaataatagagaagagttgcaattacttgcttccactgtgagaaaaatcccagccacaactccagcacacaagaacttcaaaatgcctgaactgcagtggccaagggttcctccaggacctcctcccccaggatcttgcttcaagtgccaaaaatctggccactgggtcaagaaatgcccgcagcccgggattcctcctaagccatgtcccatcggtgtgggaccccactggaaatcggcctgtccaactcacctggcagccactcccagagcccctagagctctggcccaaggctttctgactgactccttcccagatctgctcggcttagcggctgaagactgatgctgcctgatctccttggaggccccctggaccatcacggacgctgagcttcgggtaactctcacagtggacagtaagtccatccccttcttcatcaatacggaggctatccactccacattaccttcttttcaagggcctgtttcccttgcctccattactgttgtgggtgttgacggccagacttctaaacctcttaaaactccccatctctggtgccaactcggacaacattcttttgtgcactccttttaagttatccccacctgcccagttcccttattagatcgaggcattttaactaaattatctgcttccctgactattcctaggctacagccacacctcattaccgcccttttccccagttcaaagcctccttcgcatcctccccttgtatctccccaccttaacccacaagtataggacatctctactccctccttggcgaccgatcatgcaccccctaccatcccattaaaacctaatcaaccttaccccactcaatgccaatatcccatcccacagtacgctttaaaaggattaaagcccgttatcactcgcctttacaggatggccttttaaagcctatgaactctccttacaattccccattttacctgtccaaaaactggacaagtctcacaagttagttcaggatctgcgccttatcaaccaaattgttttgcctatccaccccatggtgccaaacctatgtacccttctatcctcaatacctcccttcacaacccattattctgttctggatctcaaacatgctttctctactatccctttgcgcccttcaccccagcctatcttcacttttacttggactgaccctgacacccatcaggctcagcaaactacctgggctgtactgccacaaagcttcatggacagcccccattacttcagtcaagcccaaatttcttcctcatccattacctatctcggcataattcttcatgaaaacacacatgctgtccctgctgatcatgtctggctaatctcccaaaccccaaccccttctacaaaacaacaactcctttccttcctaggcatggttaggtacttctacctttggatacctagttttaccatcctgactaaaccattatataaactcacaaaacaaaaaacaaacaaacacaaaacctagctgaccccataaatcctaaatactttccccatttccctttccattccttaaaaaacagcccgaaaagctgctcccaaactagttctccctaattcatcccaaccctttttcattacacacagccgaagtgcagggttgtgcagttggaattcttacacaagagccgggatcacgccctgtagcctttctgtccaaacaacttgaccttactgttttaggctggctaccacattattcctgataccacacctgacccccatgactgtgtctctctgatccacctggcattcacttgatttccccatatttccttctttcctgttctcaccctgatcacacttggtttatcaatggcagttccaccaggcctaattgccactcaccagcagaggcaggctatgctgtagcagtatcttccacatctatccttgaggctaccactctgcccccctccactatctctcagcaagctgaactcattgtcttaactcgagctctaactcatgcaaagggactacacgtcaatatttataccgactctaaatatgccttccatatcctgcaccaccatgctgttctatgggctgaaagacgttttctcactatccaagtgtcctccatcattaatgcctctttaataaaaattcttctcaaggcccctttacttccaaaggaagttggagtcattcactgcaagggtcatcaaaaggcatcagatcctactgctcagagcaacagttatgctgataaggtagctaaggaagcagctagcattccaacttctgtccctcatggccagttttactcttcatcggtcactcccacctaccctcccactgaaacttccacctaacaatctcttcctacacaaggcaaatggttcttggaccaaggaaaatatctccttccagcctcacaggcccattctattctgtcatcatttcataacctcttccatgtaggttataagctgctagcctgcctcttagaacctctcatttcctttccatcgtggaaatctatcctcaaggaaatcacttctcaatgttccatctgctgttctactactcctcagggattgttcaggccacctcccttccctacacatcaagctcgagaatttgcccctgcccaggactggcaaattgactttactcacatgcccaagtcaggaaactaaaaaacctcttgggctgggtagacactttcactggatgggtaaaggctttcccacagggtctaagaaggccaccatggtcatttctttccttttatcagacataattcctcagtttggccttcctacctctatacagtccaataacagaccggcctttattagtcaaatcacccaagcagtttctcaggctcttagtattcagtggaatcttcataccccttaccatcctcaatcttcaggaaaagtaaaacagactaatggtcttttaaagacacacctcaccaagctcagcctccaacttaaaaaggactggacagtacttttacctcttgcccttctcagaattagagactgtccttgagatgctacagggtatagtccatttaaacttttatatagacgcactttcttgctctgccccaatctcgtcccagacacaagccctctaggtgactaccttccagtcctccagcaggctagacagaaaatttgccaggctgctaatcttctcttgcctactccagattcccaactacgtaaaaacaccctagctggatgatcatttcttgataaaaatctgacccctcaaacactacaacccggatgaaccagaccctacttaatcatctatagtaccccaaatgccatctgcctgcaggatcctccccactgggttcaccattccagaataaagctgcatccgtttgacagccagcttaggcagcctaatctctcctcttcctcctggaagtcgcaagtactctcccctacttgccttaaactcacttgcatttctgaagaacagtaataaccttcatgagcctaatacatcccttcattctattaggtctattcgtccttaccccactttttgtaacagggctttacccaggcaccaccactacttggactgtgcccccaaaaacttgtcatccctactatcttctgtctagtcatatgcctattcaccattctcaactactcataaatgccctgctcttgtttacactgccgatttacactgtttctccaagccatcacagctgatatctcctggtgctatccccaaaccgccactcttaactccctcttaaaataaataaataatctttactggcagggcaccctccaatactttcaccctgatgaagtcctattatttacttttatactcactcttattctcgttcccgttcttatgccaccctctacctctccccagctatctccaccacactatcaatctcactcactttatcctagctatttctaatccttctttaacaaacaattgctggctttgcatttctctttcctccaaaatcgcccaggccttgacttactcactgctaaaaagaaaggggggactttgtgtatttttaaatgaagagtgttatttttacctaaatcaatctggcctggtgtatgacaacataaaaaaactcaaggatagagcccaaaaacttgccaaccaagcaagtaattacactgaacccccttgagcactctctaattggatgtcccgggtcctcccaattcttagtcctttaatacctatttttctccttctcttatttggaccttgtgtcttctgtttagtttctcaattcatacaaaaccacatccaggccatcaccaatcattctatatgacaaatgctccttctaacaaccccacaaaatcaccccttaccacaaaatcttccttcagcttaatctctcccactctaggttcccacgctgcccctaatcccgctcgaagcagccctgagaaacatcacccattatctctccatactacccccaaaaattttcaccgccacaacacttcaatactattttgttttatttttcttattaatgtaagaagacaggaatgccaggcctctcagcccaagcctgcacatatatatccagatggcctgaagcaactgaagaatcacaaaagaagtgaaaatggccagttcctgccttaactgatgacattatcttgtgaaattccttctcctggctcagaagctcccccactgagcaccttgtgacccctgcccctgcccaccagagaacaacctcctttgactgtaattttccactacccacccaaatcctataaaactgtcccacccccatctcccttattgactctcttttcggactcagcctgcctgcacccaggtgattaaaaagctttattgctcacacaaagcctgtttggtggtctcttcacatggacgtgcatgacaatattcacaatattcaaaactgggctactgcacagttgtctttaacatcatcgtgagatgatgttaaacgttaagaattctctttaacgtcatcctgaggattacctctttccttcttttatgcccagttcatggtctgcttagcaacaacccttagatgctttactgccctagacccagaggccagaaggccgccttattcttaatatgcattttatcacccagtcagctcctgacattagaaaaatcttcaaaattggaatcgggccctcaaaccccacaacaggaattaatcaacctccccttcaaggtgtacaataatagagaggaggtagccacacaataatgcatttctgagttacagctacttgcctctgctgtaagtcaatccacaaccacgtctccagcatacaaaaacttcagaacatccaagccacagctcccagggactccttcaaaacatcctcgtggaccttgcttcaaatgccaaagcctggccactgggcctcagaatgcccgcagcctgggattcctcctaagccgtgccctgtctgtgcaggcacccactggaaatcggactgactcacattgccgctgctcctaaagcccctggagcccaaacccaacgttccttggctgactccttcccagatctcctcagcttagcagctgaagactgatgctgcctgatcgcctcggaagcccccggaccatcatggatgccaagccttgggtaactcttacagtggagggtaagtccgtcccctgtttaatcaatatgggggctacccattccacattaccttcttttcaaaggcctgtttcccttgcccccataactgttatgggtattgacagccaagcttcaaaaccccttaaaactcccccactctggtgccaacttggacaacattcttttatgcactcttttttagttatccccacctgcccagttcccttattaggccgagacattttaaccaaattatctgcttccctgattattcctggactacagccacatctcattgccacccttcttcccagcccaaagcctccttcacgtcttcctctagtatcccccaccttaacccacaagtatgggacacctccactccctccctggcaaccgatcacatgcccattactatcccattaaaacctaatcacccttacccagctcaacaccagtatcccttcccacagcaggctttaaaaggattaaagcctgttatcactcgcctgttacagcatgggcttctaaaacctatgaactctccttacaactctcccattttacctgttcaaaaaccagacaagtcctacaggttagttcaggatctgtgccttatcaaccaaattattttgcctatccaccctgtggtgcccaacccgtacactcttttgtcctcaataccttcctccacaacttactattccattcttgatcttaaagatgcttttttcactattcccctacacccctcatcccagcctctctttgcttttacctggactgaccctcacacccatcagtcccagcaacttacctgggctgtactgccacaaggcttcagggacagccctcattacttcagccaacctctttctcaagatttactttctttccacccctccgcttctcaccttattcaatatattgattaccttctactttgtagcccctcctttgaatcttctcaaaaagacaacctcctgctccttcaacatttattctctaagagatattgggtatccccctccaaagctcaaatttcttctccatcctttacctaccttggcgtaattcttcataaaaacacacatgctctccctgctgatcatgtctgactgatctctcaaaccccaaccccttctacaaaacaactcctttccttcctgggcatggttggatactttcgcctttggatacctggttttgccatcctaacaaaaccattatataaactcacaaaaggaaacctagctgaccccatagatcctaaatcctttccccactcccctttctgttccttgaagatagctttagagactgctcccacactagctctccctgactcatcccaacccttttcattacacacagcccaagtgcagggctgtgcagtcagaattcttacacaaggactgggaccgcaccctgtagcctttttgtccaaacaacttgaccttactgttttaggctggccatcatgtctccatgcggtggccgccactgccctaacacttttagaggccctcaaaatcacaaactatgctcaactcactctctacagttctcacaacttccaaaatctattttcttcctcacacctgacacatatattttctgttctccaattccttcagctgtactcactctttgttgagtctcccacaattaccattgttcctggcccagacttcaatctggcctctcacattattcctgataccacacctgacccccatgactgcatctctctgatacacctggaattgactccatttccccatatttccttctttcctgttcctcaccctgatcatacctggtttattgatggcagttccagcaggcataatcgccatacaccagcaaaggcaggctatgctatagtatcttccacatctatcattgaggctaccactctgcccccctccactacctctcagcaagccaaactcattgccttaactcgagccctcattcttgcaaaggaattatgtgtcaatatttatattgactctaaatatgccttccatatccttcaccaccatgctgttatatagggagaaagaggtttcctcactacacaagggtcctccatcatt

SEQ ID NO: 251 - DNA, 692 bp, Homo sapiens
ttatagtagtaggtagtcagacaagagcagggcaggagagggctccctcaccaccaggaatgtcaggcaaccatcaggtatggtcgggcagttgttaaattgtttctctaaaataataatttgtcatagccagtaccagggaaaggcagtctcccaacagatagaaaaaacctggaactggtgatcagcagcttcccaataagacctcagaagctgggcaagtgggctcaagcatgcacattagagacagacaaaatggtggtgttttaccggtatatgaccttctagggacatttgacagctaagggaagaacatctcaattgagcatgtgcacaactccagtaaacacactgtgcagctcacctcccaagggcttgcaggccactatgcatgtggacattccaccccaagggaaagaatccagggaaaaaggatgtgagaccccagaagcatgccaatgtataaaactccaagtcaaagatcaaacagggcacttgatctctcaagttgcctgattgaccctcttccaagtgtactttactttctttcattcctgctctaaagcttcttaataaactttcactcctgctctaaaacttgcctcagtctcccctgccttacaccccctctgtcaaaatctttctttcgaagaggcaagaagtgaggttgctgcagactcttacagatttac

SEQ ID NO: 252 - DNA, 5872 bp, Homo sapiens
gtcatgcctctgagcccaagccaagccatcgcataccctgtgacttgcacgtatatgcccagatggcctgaagtaactgaagaatcacaaaagaagtgaatatgccctgccccaccttaactgacgacattctaccacaaaagaagtgtaaatggccggtccttgccttaagtgatgacattaccttgtgaaagtccttttcctggctcatcctgactcaaaaagctcccccactgagcaccttgcaacccccactcctgcccgccagagaacaaaccccctttgactgtaattttcctttacctacccaaatcctataaaatggccccacccctatctcccttcactgactctcttttcggactcagcctgcctgcacccaggtgaaataaacagccatgttgctcacacaaagcctgtttggtggtctcttcacacggatgcgcatgaaatttggtgccgtgactcggatcgggggacctcccttgggagatcaatcccctgtcctcctgctctttgatccatgagaaagatccacctacgacctcaggtcctcagaccgaccagcccaagaaacatctcaccaattttaaatccagtaagcggcctctttttactctcttctccaacctccctcactatccctcaacctctttctcctttcaatcttggtgccacacttcaatctctcccttctcttaatttcaattcctttcattttctggtagagacaaaggagacatgttttatctgtggacccaaaactctggtgctggtcatggactgggaaggcagccttcccttggtgtttaatcattgcagggacgcctctctgattatacacccacgtttcaagggtgtcagaccacgcagggacgcctgccttggtccttcacccttagcggcaatttccgcttttctggggaaggggcaagtaccccaaccccttctctccttgtctctaccccttctctgcttttctggggacagggcacgtaccccaaccccttctctccttgtctctaccccttctctgcttttctggggacagggcaagtaccccaaccccttctctccttgtctctatcccttctctgcttttctgggagaggggcaagtactcctcaaccccttctccttcactcttagtggcaagtcctgcttttctagaggatgggcaagtaccccaacctcatatctctgcaccccaatcccttatttccatgccctgacctcttatttctgtgccccatcccttatttccatgccctgacttcttatctctgcacccaaaccccttttcccacttttctggaaggtaagaacccctgaatcccttccctccatttctctactctctcttctctctaggcttgcttccttcactatgggaacattccaccctccattcctccttctactcccttggcctgtgttctcaaaaacataaaacctcaactcacacctgacctaaaacctaaatgccttattttcttctgcaatgccgcttgaccccaatgcaaactcgacagtagttccaaatagccagaaaatggcactttgaatttttccatcctgcaagatctaaataattcttgttgtaaaataggcaaacggtctgaggtgcctgacgtccaggcattcttttatacatcagtcccttcctagtctgtgcccagtgcaactcatcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaaatcttcctcagcctctgttcctccaccctataatctttttatcacctcccctcctcacacctggtccggattacagttttgttcagtgactagccctccccctcctgcccagcaatttactcttaaaaaggtggctggagctaaaggcatagtcaaggttaatgctcctttttctttatcccaaatcagaagcgtttaggctctttttcatcaaatataaaaatccagcccagttcatgacttgtttggcagcaaccgtgagacactttacagccctagaccctaaaaggtcaaaaggccgtcttattcttaaaatacattttattacccaatctgctcccgacactaaataaaactccaaaaattaaattccggccctcaaaccccacaacaggatttaatgaacctcgccttcaaggtgtacaataatagaaaaaagttgcaattccttgcctccactgtgagacaaaccccagccacatctccagcacccaagaacttccaaacgcctgaaccacagtagccaggcgttcctccagaacctcctcccacaggagcttgctacacgtgctggaaatctgtccactgggccaaggaatgcccacagcccgggattcctcctaacctgtgtcccatctgtgtgggaccccactgaaaatcggactgttcaactcacctggcagccactcccagagcccctggaactctggcccaaggctctctgactccttcccagatcttctcagcttagcggctgaagactgacgctgccggatcgcctcggaagccccctagaccatcacggacgccgagcttccggtaactctcacagggaaggtaagcccgtccccttcttaatcaatacggaggccacccacgccacattaccttcttttcaagggcctgtttcccttgcctccataactgttgtggatattgacggccaggcttctaaacctcttaaaactccccaactctggtgccaacttagacaatactcttttaagcactccttttagttatctccacctgcccagttcccttattaggctgagacactttaactaaagtatctgcttccctgactattcctggactacagctgtatctcattgccacccttcttcccaatccaaagcctcctttgcgtctcctcttgtatccccccaccttaacccacaagtataagatacctctactccctccttggtgaccgatcatgcaccccttaccatctcattaaaacctagtcacccttaccccactcaatgccaatatcccatcccacagcacgctttaaaaagattaaagcctgttatcactcgcctgctaaagcatggccttttaaaacctaaaaactctccttacaattcccccattttacctgtcctaaaaccagacaagccttacaatttagtttaggatctgcgccttatcaaccaaattgttttgcctatccaccccatggcgccaaacccatatactctcctatcctcaatacctgcctctacaacccattattctgttctagatctcaaacatgctttctctactattccgttgcacccttcatcccagcctctcttcgctttcacttggactgaccctgacacccatcaagctcagcaaattacctaggctgtactgctgcaaagcttcacagacagcccccattacttcaatcaagcccaaatttcttcctcatctgttacctatctctgcataattctcataaaaacacacgtgctctccctgccaatcgtgtccgactgatctctcaaacccaagcaccttctacaaaacgacaactcctttccttcctaggcatgattagcgcagtcagaattcttatacaagagccaggaccacaccctacagcctttctgtccaaacaatttgaccttactgttttagcctagccctcatgtctgcgtgcagcggctgccactgctttaatacttttagaggccgtcaaaatcacaaactgtgctcaattcactctctacagttctcataacttccaaaatctattttcttcctcatacctgatggatatactttttgcttcctggctccttcagctatactcacactttgttgagcctcccacaattactgttgttcctggcccagacttcaatccggcctcccacattattccagataccacacctgacccccatgattgtatctctctgatccacctgacattcaccccatttccccaaatttctttctttcctgttcctcaccctgatcacgcttgatttattgatggcagttccaccaggcctaatcgccacacaccagcaaaggcaggttatgctatagtacaagccactagcccgtctcttcgaacctctcatttcctttccatcgtggaaatctatcctcaagaaaataacttctcagtgttccatctgctattctactactcctcagggattattcaggccccctcccttccccacacatcaagctcgaggaattgccccacccaggactggcaaattagctttactccacatgccctgagtcagaaaactaaaatacctcttagtctaggtagacactttcactggataggtacaggcctttcctacagggtctgagaaggccaccacagtcatttcttccattctgtcagacataattcctcagtttagccttcccacctcaatacagtctgataacagatgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaaaaaggactggacaatacttttaccactttcccttctcagaattcaggcctgtcctcagaatgctacagggtacagcccatttaagctcctgtatagatgctcctttttattaggccccagtctcattctagacaccagaccaacttagactgtgccccaaaaaacttgacatccctactatcttctgtcttgtcatactcctattcaccgttctcaactactcatacatgccctgctcttgtttacactgcctgtttacactgtttctccaagccatcacagctgatatctcctggtgctatccccaaactgccactcttaactcttgaagtaaataaataatctttgctggcaggactatgtgaatctccttaggcactctctaatcagatatcctaagttatcctaattcttagaccttttatacctgtttttctccttctgttattccatttagtttctcaattcatccaaaactgtatccaggccatcaccaatcattctatatgacaaatgtttcttctaacatccccacaatatcaccccttaccacaagacctcccttcagcttaatctctcccactctaggttcccaagccacccctaatccaacttgaagcagccctcagaaacatcgcccattctctctccataccaccccccaaaaattttcgctgccccaacacttcaacactattttgttttatttttcttattaatataagaaggcaggaatgtcaggcctctgagcccaagccaagccatcacatcccctgtgacttgcacgtatatgcccagatggcctgaagtaactgaagaatcacaaaagaagtgaatatgccctgccccaccttaactgatgacattccaccgcaaaagaagtgcaaatggccggtccttgccttaagtgatgacattaccttgtgaaagtccttttcctagctcatcctggctcaaaaagcacccccactgagcaccttgcaacccccactcctgcccgccagagaacaaaccccctttgactgtaattttcctttacctacccaaatcctataaaacggccccacccccatctcccttcactgactctcttttcggactcagcccacctgcacccaggtgaaataaacagccatgttgctcacacaaagcctgtttggtggtctcttcacacggacgcgcatgaaa

SEQ ID NO: 253 - DNA, 5712 bp, Homo sapiens
gttaggcccctgagcccaagctaagccatcatatcccctgtgacctgcacgcacacatccagatcgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgactcccactcctgcctgccagagaacaacccccctttttcctttacctacccaaatcatataaaacggccccacctgtctcccttggctgactctctttttggactcagcccgcctgcacccaggtgattaaaagctttattgctcacacaaagcctgtttgatggtctcttcacacggacatgcatgaaatttggtgccatgagtcggatcgggggacctcccttgggagggcaatcccctgtcctcctgttctttgctccatgagaaagatccacctacgacctcaggtcctcagaccgaccagcccaaggaacatctcaccaattttaaatcgggtaagcggcctcttcttactctcttctccaacctctctcactgtccttcaaccactttctcctttccactcttcaatctctcccttctcttaatttcaattcctttcattttctggtagagacaaaggagacacgttttatccgtggacccaaaactccggcgccggtcagggactgggaaggcagccttcccttggtgtttaatcattgcagggactgcaatgattattcacccaggtttcagaggtgtcagaccatgcagggacgcctgccttggtccttcacccttagcggcaagtcctgcttttctggggaaggggcaagtaccccaaccccttctctccgtgtctctaccccttctcctcctttctggggggcaagaaatccccaaccccttctccttcaccctgagcggcaagtcctgcttttctagaggaggggcaagtaccccaacctcgtatctctgcaccccaatcccttatttccgtgccccgacctcttatctctgcgcccaatctcttatttccgcgccccaacctcttatatctctgtgccccaatcccttatttccacaccccaacctctaatctctgtgcccccatcccttatttccgtgccccaacctcttctccgtgccccaacccctttcccgcttttctggaaggtaagaacccccaaaccccttccctccatgtctctactctctcttttctctaagcttgcttccttcactatgggcaactttccaccctccattcctccttcttctcccttagcctgtgtcctcaaaaacttaaaacctcttcaactctcacctaaattaaaatctaagcatcttattttcttctgcaatgccgcttgaccccaatacaaactcaacagtagttccaaatagccggaaaacggcactttcaatttttccatcctacaagatctaaataattcttgttgtaaaatgggcaaatggtctgaggtgcctgacatccaggcattcttttacacatcggtccctctctagtctctgttcccaatgcaactcatcccaaatcttccttctttccctcccacctgtcccctcagtcccaaccccaagcgtcgctgaggctttctaatcttccttttctacggacccatctgacctctccccacctccccaggctgctcctcgccaggcccagctaggtcccaattcttcctcagcctccgctcctccaccctataatccttttatcacctcccctcctcacacctggtctgccttacagtttcgtttcgtgactagccctcccccacctgcccagcaattgactcttaaaaaggtggctggagctaaaggcacagtcaaggttaatgctcctttttctttatcccaaatcagatagcgttttcatcaaacataaaaacccagcccagttcgtgactcctttggcagcagccctgagacgctttacagccctagaccctaaaaggtcaaaaggccgtcttattctcaatatacattttattacccaatctgctcccgacattaaataaaactccaaaaattagaatctggcactcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccctaggagcttgctacaagtgctagaaatctggccaccaggccaaggaatgcctgcagcccaggattcctcctaagccatgtcccatctgtgtgggaccccactggaaatcggactgtccaactcacctggcagccactcccagagcccctggaactctggcccaaggctctctgactgcttcccagatcttcttggcttagcggctgaagactgatgctgcccgactgccttggaagccccctagaccatcacagacgccgagcttcgcgtaactctcacagtggaaagtaagtccgtccccttcttaatcaatacggaggctacccactctacattaccttcttttcaagggcctgtttcccttgcctccataactgttgtgggtattgacagccaggcttctaaacctcttaaaactccccaactctggtggcaacttagacaatactcttttaagcactcattttagttatccacacctgcccagttcccttattagggcgagccactttaactaaattatctgcttccctgactattcctggattacagctacatctcattgctgcccttcttcccagtccaaagcctcctttgcgtcctcctcttatattcccccaccttaacccacaaatataagatacctctactccctccttggtgaccgatcatgcatcccttaccatctcattaaaacctaaccacctttaccccgattaatgccaatatcccatcccacagcatgctttgaaagggttaaagcctgttatcacttgcctgctacagcatggccttttaaagcctataaactctccttaccattcccccattttacctgtcctaaaaccaagcaagccttacaagttagttcaggatctatgccttatcaaccaaattgttttgcctatccaccccatggtgccaaacccatatactctcctatcctcaatacctccctccacaatccattattctgttttggatctcaaacatgctttctttactattcctttgaacccgtcatcccagcctctctttgctttcacttggactgaccctgacacccattaggctcagcaaattacctgggctgtactgccgcaaggcttcacagacagcccccattacttcagtcaagcccaaatttcatcctcatctgttacctatctcagcataattctcataaaaacacacgtgctttccctgctgatcgtgtccgattaatctcccaaacctcaatcccttacaaaacaacaacgcctttccttcctaggcatggttagtgcggtcagaattcttacacaagagccaggaccgcaccctgtagccttcctatgcaaacaacttgaccttactgttttagcctagccctcatgtctccatgcagcggctgctgccgccctaatacttttagaggccctaaaaatcacaaactatgctcaactcactctctacatttctcataacttccaaaatctattttcttcctcacacctgacgcatatactttctgctccccggctccttcagctgtactcagtctttgttaagtcccacaattactattgttcctggcccggacttcaatccggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttagaacctctcatttcctttctatcatggaaatctatcctcaaggaaataacttctcagtgttccatctgctattctactactcctcagggattattcaggccccttccttccctacacatcaagcttgaggatttgcccccacccaggactggcaaattagctttactcaacatgtcccaagtcaggaaactaaaatacctcttagtctaaatagacactttcactggataggtagaggcctttcctatagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaatctttatatcccttatggtcctccgtcttcaggaaaagtagaacggactaaaggtcttttaaaaacacacctcaccaagctcagctaccaacttaaaaaggactggacaatacttttacgactttcctttctcagaagtcagacctgtcctcagaatgctacaaggtacagcccatttgagctcctgtatagacgctcctttttattaggccccagtctcattccagacaccagaccaacttagactgtgccccaaaaaaacttatcatccctattatcttctgtctagtcatactcctattcaccgttctcaactactcatacacgccctgctcttatttacactgccggtttacgctgtttctccaagccatcacagctgatatctcctggtgctatccccaaactgccactcttaactcttgaagtaaataaataatctttgctggcaggactgtgctgaatctccttaggcactctctaatcagatgtcctgagttgtcccaattcttagaccttttatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacaccgcccctaatcccgctgaagcagccctgagaaacatcgcccattatctctccataccacccccaaaaattttcgctgtcccaaaactttaccactatttagttttatttttcttattaatataagaagacaggaatgtcagccctctgagcccaagcaaagccatcatatcccctgtgacctgcacgtacacatccagatcgccggttcctgccttaactgatgacattccaccacaaaagaagtgaaaatggcctgttcctgccttaactgatgacattttcttgtgaaattccttctcctggctcatcctggctcaaaagctcccccattgagtaccttgtgacccccactcctgcccgccagagaacaacccccctttttcctttaccttcccaaatcctataaaaccgccccacccctgtctcccttggctgactttcttttcagactcagcccacctgcacccaggtgattaaaagctttattgctcacacaaagcctgtttggtggtctcttcacacggacgcgcatgaaa

SEQ ID NO: 254 - DNA, 4587 bp, Homo sapiens
gtcaggcctctgagcccaagcaaagccagcatatgccctgtgacctgcacgtatacatccagatgacctgaagcaactgaagatccacaaaagaagagaaaatagccttaactgatgacattccaccattgtgatttgttcctgccccatcctaactgacatgatatagtctcccctgcccttaagaaggtgctttgtaatattctccccagcccttaagaatgtactttgtatgcctatcccaaacctataagaactaatgataatcctactaccctttgctgacttcttttttggactcagcccgccggcacccaggtgaaataaacagccttattgctcacacaaagcctgcttggtgctctcttcacacagacgcgtgtgacatttggtgccaaagacccgggacaggtggactcctttgggagatcagtcccctgtccttgccctcactccatgaggagacccacctacaacctcgggtcctcagaccaaccagcccaaggaacatctcaccatttcaaatcaggtaagcggtcttttcactgttctccagtctctcttgctacccttcaatctccctgtccttccaattccagctctttttcctctctagtagagacaaaagagatacattttatccatggacccaaaactccagcgtcggtcacggactcgggaagacagtcttcccttggtgtttaatcactgtggcgatgcctgcctgaatattcacccacactccattgatgtctgattaccgtggggacgcctgccttggtcattcacccacattacctcagtggcaggtcaattgcggggacacctgctttggctgctcatccacattgcagcccagggctgctcaccgccccccactgccccttctccgtgtctctacctttctctttaaactcacctccttcactatgggcaaccttccgccctccattcccccatcttctcccttagcctgtgttcttaaaaacctaaaaccccttcgactcacacctgacctaaaacctaaacactttattttcttctgcaatactgcttggccccagtacaaactcgacagtagttccaagtagccagaaaacggcacttttgatttctccattttacaagacctggatgatttttgtcgaaaaatggacaaatggtctgaggtgcctgacgtccaggcattcttttacacatcagtccctccctagtctctgttcccaatgtgactcatcccaaatctttcttctttctctcctgtctgttccttcagtctccaccccaagttctgagtcctttgaatccttcttttctatggactcatctcacctctccccttctcgccaggctgctcctcaccaggccgagccaggtcccaattcttcctcagcctctgctcccccactgtataatcctcctatcatctcccctcctcacacccggtctggcttacagtttcgttccacgactagccctccctcacctgcccaacagtttcctcttgaagaggtggctagagctaaaggcatagtcaaggttaatgctccttttttctttatccgacctctcccaaatgagttagcatttaggctctttttcgtcaaatataaaaacccagcccagttcatggcctgtttggcaacaacccttagacactttactgtcctagaccccagaggaaggctgtcttattctcaatatgcattttattacccaatctgctcccgacattagaaaaagctccaaaaattagattccagccctcaaaccccacaagaagacctaattaacctccccttcaaggtggtatacaataatagaatagaggcagccaagtggcaacgtatttctgagttgcaattacttgcctccactttgagagaaaccccagccacatctccagcatacaagaacttcaaaacgtctgaaccacagtagccaggtgttcctccaggactgcctcccccaggagattgtttcaagtgctggaaatctggccactgggccaaggaatgctcgcagcctgggattcctcctaagccatgtgccaactgtgcaggaccccactggaaattggactgtccaactcgcccggcagccactcccagagcccctggaattctggcctaaggctctctgactgactccttcccagatcttcttggcttagcagctgaagactgatgccgcccgatctccttggaggccccccggacaatcactgatgccgagctttgcgcaactcttacagtggagggtaaggccgtcctcttcttaattaatatggaggctaccaactccacattaccttcttttcaagggcctgtttcccttgcctccataactgttgtgggtattgacggccaggcttctaaacctcttaaaactccccaactctggtgccaacttgaacaacattccttaatgcagtccttttgagttatccccacttgcccagctcccttattaggtcgagacattttaactaaattatctgcttccctgactattcctgggctacagccgtacctcattgccgcccttttccccagttcgaagtctccttcacatcctcaccttgtatctccccaccttaatccacaagtatgggatacctctactccctctttggcaaccgatcatgtgccccttaccatcccattaaaacctaatcacccttacccagctcaacgccaatatcccatcccacaacaggctttaagaggattaaagcctgatatcacttgcctgctacagtatggccttttaaagcctataaattctccttacaattctcacattttacctgtccaaaaaccggacgagtcttacaggttagttcaggatctgaaccttatcaaccaaattgtcttgcctatccaccccgtggtgccaaacccatatactctcctatcctccacacctccctccacaacccattattctgttctagataaacctagctgaccccataaatcctaaatccttcccctactcccctttccattccttaaaaaacagccctaaaagctgctctcacactagctctccctaactcatcccaacccttttcattacacacagccgaagtacagggctgtgtggtcagaattcttacacaagaaccgggaccgcgctctgtagcctttctgtccaaacaacttgaccttactgttttagcctagccatgtctgcgtgtggcggctgccactgctttaatacttttagaggccctcaaaatcacaagctatgctccacttactctctacagttctcataactttcaaaatctattttcctcctcacacttgatgcatatactttctgcccctcagctccttcagctatactccctctttgttgagtctcccacaattaccattgctcctggcccagacttcaatctggcctcccacattattccggataccacacctgatccccatgactgtatctctcatccatgtgacagtcactccatttccccatatttccttctttcctatttctcatcctgatcacacttggtttattgatggcagttccaccagggctaattgccactcaccagcaaaggcaggctatactatagtattttccatgtttatcattgaggctaccactctgcccccctccactacttctcagcaaaccgaactcattaatctctcccactctaggttcccatgctgcccctaatccctttcaaagcagccctgagaacatcacccattatctctccataccacccccaaaaattttcgccaccccaacacttcaccactattttgttttgtttttcttattaatataagaagacagggatctcaggcctctgagcccaagcaaagccatcatatcccctgtgacctgcaggtatacatccagatggcctgaagcaactgaagatccacaaaagaagtgaaaatagccttaattgatgacattccacccttgtgatttgttcctgccccaccctaactgatatgacatagtctctgccgcccttaaaaaggtactctgtaatattctcccctgcccttaagaaggtactttgtaatattctcccctgcccttaagaaggtattttgtaatattctccatgcccttaagaatgtactttgtacgcctatcctaaacctataagaactaatgataatcgggcaggcacggtggctcacgtctgtaatcccagcatttggaaggccgaggtgggtggatcatgaggtcaggagatcaagaccacggtgaaaccctgtctctactaaaaatacaaaagaaaaaaaattagccaggcatggtggcgggcgcctatagtcccagctactcaggaggctgaggcaggaaaatggcatgaacccgggaggcagagcttgtagtgaaccaagactgagccactgcactctagcctgggcaacacagcaagactctgtctcaaaaaaaaaaaaaaaaagaactaatgataatcccaccaccctttgctgactcctttttggactcagcccacctgcacccaggtgaaataaacagccttgttgctcacagaaagcctgtttggtggtctcttcacaaggatgcgcgtga

SEQ ID NO: 255 - DNA, 963 bp, Homo sapiens
gagaaaagaaagagagatcagactgttactgtgtctgtgtagaaagaagtagacataagagactccattttgttctgtactaagaaaaattcttctgccttgagatgctgttaatctgtaaccctagccccaaccctgtgcttgcagagacatgtgctgtgttcactccaggtttaatggatttagggctatgcagaatgtgcttcgttaaaaaagtgcttgaaggcagtatgcttgttaaaagtcatcaccattctctaatctcaagtatccagggacacaatacactgtggaaggccacagggacctctgtctaggaaaaccaggtattgtccaaggtttctccgcatgtggtagcctgagatatggcctcctgggaagggaaagacctgactgtcccccagcccgacacctgtaaagtgtctgtgctgaggaggattagtgaaagacaaaggcctctttgcagttgtgataagaggaaggcatctgtctcctgcttgtccctgggcaatggaatgtctcagtgtaaaacccgattatgtgttgtatttactgagataggagaaaaccgccttagggctggaggtaagactgctagcagcaatactgctctttaatgcaccgagatgtttgtatacgtgcatatcaaggcacatcaccttttcttaaccttgtttatgacacagagacctttgtttacatgttttcctgctgaccctctccccactattaccctattgtcttgccacatccccctctccgagattgtagagataatgatcaataactactgagggaactcagagaccagtgctggtgctggtcctccgtatgctgagcgccggtcccctgggcccacttttctttctctatactttttctgtgtgtctctttctttcctcagtctctcatcccacctgacgagaaacgcccacaggtgtggaggggccaccccttcataca

SEQ ID NO: 256 - DNA, 5762 bp, Homo sapiens
gtcaggcctctgagtccaagctaagccatctcatcccctgtgacctgcacgtatacattcagatggcctgaagtaactgaagaatcacaaaagaagtgatatttaaatggtctgttcctgccttaactgatgacattctaccacaaaagaagtgaaaatggctggtccttgccttaactgatgacattaccttgtgaaattccttctcctggctcatcctggctcaaaaagctttcccactgagcaccttgtgactcctagtcctgcccaccagagaaaaaccccctttgactctaattttcctttacctacccaaatcctgtaaaatggccccacccctatctccctttgctgactctcttttcagactcagtccgcctgcccccaagtgaaataaacagccttgttgctcacacaagcctgtttggtggtctcttcccaaggacactagtgaaattttggtgccatgactcggatcgggggacctcacttgggagattaatcccctgtcctcctgctctttgctctgtgagaaagatccacctatgacctcaggtcctcagaccgaccagcccaaggaacatcacaccaattttaaatcaggtaagcggcctctttttacactctcctccaacctctctcactatccctcaacctctttctcctttcaatcttggcgccacacttcaatctctcccttctcttaatttcagttcctttcctgttctcatagagacaggagatgcattttatctgtggacccaaaactccagcgccggtcagggacttgggatgacagtcttcccttggtatttaatcacacagggatgcctgcctgattattcacccacatttcagaggtgtctgaccacacagggatgcctgccttggtccttcacccttagtggcaagtatcacttttctgggggacaagaaccccccgaccccttctctccatgtctctaccccttctccacttttctggaaggtaagaaccccccgaccacttctctccatgtctctatcccttctctgcttttctagggggcaagaacccccccaccccttctcttcatgtctctactgtctcttttctctgggcttgcctccttcactataggcaagcttccgccctccattcccccttcttctcccttagcctgtgttcttaaaaacctaaaacctcttcaactcacacctgacctaaaacctaaatgccttattttcttctgcaatggcacttgcccccatacaaactcgacagtggttccaaatagccagaaaatggcactttcaatttttccaccctacaagatctaaataattcttgttgtaaaatgggcaaatggtctgaggtgcctgacgtccaggcattcttttacacatcagtccctccctagtctctgttcccaatgcaactcatcccacatcttccctctttccctcccgcctgtcccctcagtcccaaccccaagtgtcactgagtctaatcttccttttctacagacccatctaacctctcccctcctagccaggctgagctaggtccaaattcttcctcagcctccactcctccaccctataatctttttatcacctcccctcctcacacccagtctggcttacactttcattccatgtgtagcccttccccacctgcccagcaatttcctcttaaaaaggtggctggagctaaaggcatagtcaaggttaatgctcctttttctttatcccaaatcagatagcgtttaggctctttttcatcaaatataaaaacccagcccagttcatggcttgtttggcagcaaccctgagatgctttacagccctagaccctaaaaggtcaaaaggccaacttattcttaatatgcattttattacccaatccactcccaacattaaataaaactccaaaaaataaattccggccctcaaaccccacaacaggacttaattaacctcaccttcaaggtgtataataatagaatagagacagccaagtagcaacatatttctgagttgcaattccttgcctccactgtgagacaaaccccagccacatctccagcacagaagaacttccaaacgcctaaaccacagtggccaggcgttcttccaggcccgcctcccccaggagcttgctacaagtgccagaaatctgtccaccaggccaaggaatgcccaaagcctgggattcctcctaagccatgtcccatctgtacgggaccccactggaaattggactgtccaacttacccagaagccactcccagaggccctggaactctggcccaaggctctctgactgactccttcccagatcttctcggcttagcagctgaagactgataccgcccgatcacctcggaagcctgcaggaccatcacagacgctctaggtaactctctcggtggaaggtaagtctgtccccttcttaatcaatatggaggctacccactccacattaccttcttttcaacggcctgtttcccttgcctccataactgttgtaagtactgacagccaggctcctaaacctctaaaaactccccaactctggtgccaacttagacaatactcttttaagaactgcttttcattatccccacctgcccagttcccttattaggctgagacactttaactaaattatctacttccctgactattcctaggctacagccatacctcattgctgccttttcccccagttcaaagcctccttcacatcctccccttgtatctcctcaccttagcccacaagtataagacacctctactccctccttagcaactgatcatgcaccccttaccatcccattaaaacctaatcacccttaccctgctcaatgccaatatcccatcccacagcacgctttaaaaggattaaagcctgttatcattggcctgttacagcatggccttttaaagcctataaactctccttacaattcccccattttacctgtcctaaaaccagacaaggcttacaggttagttcaagatctgcaccttatcaaccaaattattttgcctatcgaccccgtggtgccaaacccatatactctcctattcttaatacctccctccacaacccattattctgttctggatctcaaacattctttctttactattcctttgcacccttcatcccagcctctcttcactttcagttggactgaccctgacacccatcaggctcagcaaattacctgggctgtattgccacaaggcttcacagacagcccccattacttcagtcaagcccaaatttcttcctcatctgttacctatctcagtgtaatcctcataaaaacacacatgctctccctgccgatcatgtccgactgatctctcaaaccccaacaccttctacaaaacaacaactcctttccttcctaggcatggttggatacttttgactttagatacatggttttgccatcctaacaaaaccattatataaactcacaaaaggaaacctaactgaccccatagatcctacatccttttcccactcgttttccgttccttgaagacagctttagagactgcccccaccctagctctcccagactcatcccaacccttttcattacccacagctgaagtgcagggctgtgcagtaggaattcttacacaagaaccaggaccgtgccctgtagcctttttatccaaacaacttgaccttactgttttgcctagccttcaagtctgcatgcagcggccgccaccaccctaatgctttcagaggcccttaaaatcacaaactatgctcaactcactctctacagttctcataacttccaaaatctattttcttcctcacacctgacacatataccttctgcttcccagctccttcagctgtactcactctttgttgagtctcccacaattacctttgttcctggcctggacttcaatctggcctcccacattattcctgataccacacctgacccccatgactgtatctctctgatctacctgatattcaccccatttccccatatttccttctttcctgttcctcaccctgatcacactggtttattgatgtcagttccacaaggcctaattgccacacaccagaaaaggcaggctatgctatagtacaagccactagcccacctcttagaacctctcatttcctttccatcatggaaatctatcttcaaggaaataacttagtgttccatctgctgttctactacttctcagggattattcaggccccctcccttccctacacatcaaactcggggatttgcccctgcccaggactggcaaattggctttactcaacatgcctgagtcaggaaactaaaatacctcttggtctgggtagacactttcactggataggtagaggcctttcccacagggtctaagaaggccaccatggtcatttcttcccttctgtcagacataattcctcggtttggccttcccacctctatacagtcctgtagcggaccagcctttattagtcaaatcatccaagcaatttctcaggctcttagtattcagtgaactaatggtcttttaaaaacacacctcaccaagctcagccaccaacttacaaaggactggacaatatttttaccacttgcctttctcagaattcaggcctgtccttggaatgctacaaggtacagcccatataagctcctgaatagatgctcctttttattaggccccagtctcattccagacaccagaccaacttggactgtgccccagaaaacttgtcatccctactatcttctgtctagtcatactcctattcactgttctcaactactcataaatgccctgctcttgtttacactgctggtttacgctgtttctccaagacatcacagctgatatctcctggtgctattcccaaaccgccactcttaactcttaaagtaaataaataatctttgctggcaaggctatgctgaacctccttaggcactctctaattaggtgtcctgggtcctcccaattcttagtcctttaatacttgtttttctccttctcttattccatttagtttttcaattcatacaaaaccatatccagtccatcaccaataattctacatgacaaatgtttcttctaacaatcccacaatatcaccccttaccacagaatcttccttcagcttaatctctcccactctaggttcccacaccgcccctaatcccgctcgaagcagccccgagaagcatcgcccattatctctccatgccaccccccaaaaaatttttctcactgccccaacacttcaatactattttatgttatttttcttattaatataagaaggccgtaatgtcaggcctctgagcccaagctaagccatcgcatccccctgcatgtatacatccagatggcctgaagtaactgaagaatcacaaaagaagtgatatttaaatggtctgttcctgccttaactgaggacattccaccacaaaagaagtgaaaatggccagtccttgccttaactgatgacattaccttgtgaaattccttctcctggctcaaaaagctcccccactgagcaccttgtaacccccactcctgccctccagagaacaaccaccctttgactgtaattttcctttacctacccaaatcctgtaaaacagccccacccctatctcccttggctgactcttttcggactcagcctgcctgcccccaggtgaaataaacagccttgttgctcacacaagcctgtttggtggtctcttcacagggacgca

SEQ ID NO: 257 - DNA, 117 bp, Homo sapiens
ccaaatagactctttggcagcagtgactctccaaaaacgccaaggcctagacctcctcactgctgagaaaggaggactctgcaccttcttaggggaagaatgtggttttcacactaa

SEQ ID NO: 258 - DNA, 3615 bp, Homo sapiens
gtaggtggcctgttcctgccttaactgatgacattctaccacaaaagaaatgaaaatggcctgttcctgccttaactgatggcattatcttgtgaaattccttcttctggctcaaaagcccctttactgagcaccttgtgacctctactcctgcctgccagagaacaacctccctttttcctttacttacctaaatcctataaaacggtcctaccccatctcctttcgctgactctcttttcggactcagcttgcctgcacctaggtgattaaaagctttattgctcacacaaagcctgtttggtggtcacacagacacacatgaaatttggtgccgtgactcggatcaggggacctcccttaggagaccaatcccctgtcctcctgttctttgctccggaagaaagatccacctacgacatcagttcctctgaccaaccagcccaaggaacatctcaccgattttaaatccggtaagcagcctctttttactctcttctccaacctccctcactatccctcaacctctttctcctttcaatcttggcgccacacttcaatctctcccttctcttaatttcaattcctttcattttctggtagagacaaaggagacacgttttatccctggacccagaactccggcgctggtcacggactgggaaggcaggcttcccttggtgtttaatcatcgcaaggacgcctctgattattcacccacgtttcagaggtgtcagaccacgcagggacacctgccttggtccttcacccttagtggcaagtcccacttttctgggggaagggcaagtaccccagccccttctctccgtgtctctacccctctccgcttttctggaggagggttaagaacccctcaaccccttctccttcactcttagcggcaagtcccgcttttctagggggcaagaacccccaatcccttatttctgtgccctgacctcttatctctgcaccccaatcccttatttccatgccccagcctcttatctctgtaccccatcccttatttctgcactctgacctcttatctctgtgccccaatcccttatttctgcaccccgacctcttatctctgcaccccgatcccttatttccatgcccagatctcatctctgcgcccccatctcttatttccacactccgacctcttatctctgcgccccaaccccttatttctgcaccccgacccctttctcgcttttctggagggtaagaacccccgaaccccttccctccgtgtctctactctctcttttctctgggcttgcctccttcactataggcaatcttccaccctccattcctctttcttctcccttagcctgtgttcttaagaacttaaaacctcttcaattctcacctgacctaaaatctaagcatcttattttcttctgcaatgccgcttgaccccaatacaaactcgacagtagttccaaatagtcagaaaatggcactttcaatttttccatcttgcaagatctaaataattcttgtcgtaaaataggcaaactgtctgaggtgcctgacgtccaggccttcttttacacatcagtccctccctagtctctgtgcccagtgcaactcatcccaaatcttccttctttccctcccgcctgtcccctcagtcccaaccccaagcgtctttgagtctttctaatcttccttttctacagacccatctgacctctcccttcctccccaggctgctcctcgccaggctgagctatgtcccaattcttcctcagcctctgctcctccaccctataatccttctaccacctcccctcttcacacctggtccggcttatagtttcgttcagtgactagccctccctcacctgcccagcaatttactcttaaaaaggtggctgaagctaaaggcatagtcaaggttaatgctcctttttctttatcagacctctcccaaatcagtgagcgtttaggctctttcatcaaatatgaaaaacccagcccggttcatggctcattcggcagcaaccctgagacgcttaacagccctagaccctaaaaggtcaaaaggccgtcttattctcaatatacattttattacccaatctgctcccgacattaaataaaactccaaaaattaaattccggccctcaaaccctacaacaacacttaattaacctcaccttcaaggtgtacaataatagaggcagccaagtagcaacatatttctgagttgcaattctttgcctccactgtgagacaaaccccagccacatctccagcacacaagaactccaaactcctaaactgcagctgccaggggttcctctagaacctcctcccccagaggcttgctacaagtgccagaaatctggccactgggccaaggaatgcccacagcccgggattcctcctaagccatgtcccatctgtgcgggaccccactgaaaattggactgttcaactcacctggcagccacttccagagcccctggaactctggcccaaggctctctgactccttcccagatcttctcagcttagcagctgaagactgacactgcccgatggcctcagaaacctacaggaccatcacagacgttctaggtaactctcacagtggggggtaagtccgtccccttcttgatcaatacggaggctactcactccacattactttgttttcaagggcctgtttcccttgcttccataactgttgtgcgtactgacagccaggcttctaaacctcttaaaactctgcaactctggtgccaactcaggcaatactcttttaagcactcctttttagttatccccacctgcccggttcccttattaggccaagacacttaaactaaattatctgcttccctgattattcctgggctacagccacacctcattgccaccttttcccccagttcaaagcctccttcacatcctccccttgtatctccccaccttaacccacaagtataagacacctctactccctccttagcgaccgatcatgcaccccttaccatcccattaaaacctaatcactcttacctcgctcagtgccaatatcccatcccacagcatgctttgaaaggattaaagcctgttatcactcgcctgttacagcatggccttttaaagcatataaactcttcttaccattcccccattttacctgtcctaaaaccagacaagccttacaagttagttcaggatctgcgccttatcaaccaaattgttttgcctatccaccccatggtgccaaacccgtatactctcctatcctcaatacctccctctaccacccgttattctgttctggatctcaaacatgctttctttactgttcctttgcacccttcatcccagcctctctttgctttcacttagactgaccctgacacccattaggctcagcaaattacctgggctgtactgccgcaaggcttcacagacagcccccattacttcagtcaagcccaaatttcatcctcatctgttacctatcttggcataattctcataaaaacacatgtgctctccctgctgatcgtgtccgattaatctcccaaacctcaatcccttacaaaacaataactcctttccttcctaggcttggttag

SEQ ID NO: 259 - DNA, 254 bp, Homo sapiens
caggcctctgagcccaagctaagccatcatatcccctgtgacctgcacatatacatccagatggcctcaagcaactgaagaatcacaaaagaagtgaaaatagccagttcctgccttaactgatgacattccaccattgcgatttgttcctgccccaccctaactgatcaattaaccttgtgacattccttctcctagacaatgagtctcagaacctccccactgagtaccttgtaacccccatccccgctcac

SEQ ID NO: 260 - DNA, 366 bp, Homo sapiens
gtcaggcctctgagcccaagcctgcacatatacatccagatggcctgaagcaagtgaagaatcacagaagaaatgaaaatggccggttcctgccttaactgatgacactaccttgtgaaattccttttcctggctcagaagctcctccactgggcaccttatgtcccctgcccctgcccaccaaagaacaaccccctttgactgtaattttccactacctacccaaattctataaaacggccccacccgtatctcccttcactgactctctttttggactcagctcgtctacacccagatgattaaaaacctttattgctcacacaaagcctgtttggtgatctcttcacacggatgcgtgtgaga

SEQ ID NO: 261 - DNA, 411 bp, Homo sapiens
gtcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtgaaa

SEQ ID NO: 262 - DNA, 6713 bp, Homo sapiens
gtcaggcctctgagctgaagctaagccatcatatcccctgtgacctgcacatatacatccacctggcctgaagcaactgaagatccacaaaataagtgaaaataaccttaactgatgacattccaccattgtgattttttcctgccccaccctaactgatatgatatattctcccccgcccttaagaaggtactttgtaatattctccccagtcttgagaatgtactttgtaatattgtccccactcttgagactgtactttgtacgcctatcccaaacctataagaactaatgatgatcccaccaccatttgctgagtcctttttcggactcagcccgcccacacccagatgaaataaacagccttgttgctcacacaaagcctgttggtggtctcttcacacagacgtgcgtgacgtttggtgccaaaactcgggacgggaggactccttcgggagaccggtcccctgtcctcaccttcactgggtgaggagatccacctacaactcgggtcctcagaccaaccagccaaaggaacatctcaccaatttcaaatcaggtaagtggtcttttcgctcttctccagcctctctcactaccctccagccttcctctctcgctacccttcaatcttcctgtccttccaattccagttctttttcttctctagtagagacaaggagacacattttatccatggacccaaaactccggcgccagtcacggactcgggaagacagcctttccttggtgtttaatcaccgcggggacgcctgcctgattattcacccacactccattggtgtctgatctccacggggacgcctgcctgattattcacccacattcccttggtggtcagtcaattgtggggatgcctgctttggctgctcacccacattgcagcccagggctgctcactaccccctcttctccgtgtctctaccctctctgttctctgggcttgcctccttcactatgggcaaccttccaccctccattcctccttcttctcccttagcctgtgttctcaaagacttaaaacctcttcaactcagacctgaactgaaacctaagcgtcttattttcttctgcaacaccgcttggccccagtacaaactcgacaatgattccaaatagccagaaaatggcactttcaatttctccatcccacaagatctagataattcttgtcataaaatggacaaatggtctgaggtatctgatgtccaggcattcttttacacttcagtcccttcctaatctctgctcctgatgagactcatcccaaaactttcttctttctctcctgtctgttccttcagtctccaccccaagctctgagtcctttgaatcctccttttccacagactcatctgacctctcctcttctcctcaggctgctcctcgccaggctgagccaggtcccaactcttcgccagcctctgctcccccaccctataatccttctatcacttcccctcctcacaccgggtctggcttacagttttgttctgcgtctagccctcccccacctgcccaacagtttcctcttagagaggtggctggagctgaaggcatagccaaggttaatgctcctttttctttacccaacctctcccaaatcagttagtgtttaggctctttttcatcaaatatgaaaaccccgctcagtccatggcccgtttggcaacaacccttagatgctttaccgccctagacccagaggggccagaaggccgtcatattctcaatatgcattttattacccaatccgctcctgacattagaaaaagctccaaaaattggattctggccctcaaccccacaacaggacttaattaacctcaccttcaaggtgtacaataatagagaagagttgcgattacttgcctcttctgtgagagaaaccccagccacatctccagcacacaagaacttcagaacgcctaaactgcaagggtcaggcattcctccaggactgccttccccaggatcttgcttcaagtgccagaaatctggccactggggcaaggaatgcccacagcccaggattcctcctaagccatgccccacctgtgcaggaccccactggaaatcggactgtccaactcgcccagcagacagtcccagagcccctcgaactctggctcaaggttctctgactgactccttcccggatcttctcggcttagtggctgaagactgacgctgtccgattgcctcagaagcctcctggaccatcacggacgctttgagtaactcttacagtggagggtaagtctgtccccttcttgatcaatacggaggctacccactccacattaccttcttttcaaaggcctgtttcccttgcctccataactgttgtgggtattgacagccaggcttctaaacctcttaaaactccccaactctggcgccaactgggacaacattcttaactccccaactctggcgccaacttggacaacattcttttatgcactctttttttatttatccccacctgcccagctcccttattaggtcaggacactttaaccaaattttcttcttccctgactactcctgggctacagccacacctcattgccgcccttttccccagttcagagcctccttcacgtcctccccttgtgtcttcctaccttaatccacaagtatgggacacctctactccctccttagtgactgatcatgcaccccttaccatcccattaaaacctaatcacccttaccctgctcaatgccaatatcctatcccacagcacactttaaaaggattaaagcctgttatcactcacccgttacagcatggccttttaaagcctataaactctccttacaattccccccttttacctgtgcaaaaactggacaagccttataggttagttcaggatctgtgccttatcaaccacattgtcttgcctatccaccctatggtgccaaatccatatactctcctatcctcaatacctccctccacaacccattattctgtcctggatctcaaacatggtttctttactattcctttgcacccttcatcccagcctctctttgcttttacctggactgaccctgacacacgtcagtcccagcagcttacctgggctatagtgccacaaggcttcagggacagccctcattacttcagccaagccctttctcgtgatttactttctttccacccctctgcttcccaccttattcaatacatggatgaccttttactttgtagtccctcctttgagtcttctcagtaagataccctcctgctccttcaacatttattctccagaggatatcaggtatcccccctccaaagctcaaatttcttccccatccgttacctacctcagcataattcttcatgaaaacatgcatgttctccctgccaatcatgtctggctaatctctcaaactccaaccccttctacaaaaaaacaacttctttccttcctgggcatggttggatactttcatctttggatacctggttttgccgtactaacaaaacctaatgtaaactcataaagggaaacctagctgaccccatagatcctaaatcctttccctactcctctttccgttccttgaagacagctttagagactgctcccacactagctctccctgactcatcccaacccttttcattacacacagccaaagtacagggctgtgcagtcggaatttttacacaaggaccaggattcctacacaaggctactgtgccctgtagcctttttgtccaaacaacttgaccttactgttttaggctggccatcatgtctctgtgcagcagctgccactgccttaatacttttagaggcccttgaaatcacaaactgtgctcaactcactctctacagttcttataacttccaaaatctattttcttcctcacacctgatgcatatactttctgctctccggctccttcagctatactcactctttgttgagtctcccaaaattaccattgttcctggcccagacttcaatctggcctcccacattattcctgataccacacttgacacccatgactgtatctctctgatacacctggcattcactccatttccccatatttccttctttcctgttcctcaccctgatcacacttggtttattgatggcagttccatcaggcctaattgccactcaccagcaaaggcaggctatgctatagtatcttccatatttatccttgaggctaccactctgccccactccactacttctcagcaagccaaactcattgccttaactcaggccctcactcttgcaaagggactacacatcaatatttatactgactctaaatatgccttccatatcctgtaccaccatgctgttatatgggcagaaagaggtttcctcactacgcaagggtcctccatcatcaatgcctccttaataaaaagtcttcttaaagctgctttacttccaaaggaagctggagtcattcactgcaagggccatcaaaaggcatcggatcccatcgctcagggcaatgctaaagaagcagctagcattccaacttctgtccctcatggccggtttttctccttctcatcagtcactcccacctactcccccaccgaaacttccacctatcaatctcttcccacacaaggcaaatggttcttggaccaagaaaaatatctccttccagcctcacaggcccagtctattctgtcgtcctttcataacctcttccatgtaggttacatgccactagcctgcctcttagaacctctcatttcctttccattgtggaaatctatcctcaaggaaatcacttctcagtgttccatctgctattctattactcctcagggattgttcaggccccctcccttccctacacatcaagctctgggatttggccctgcccaggactggcaaattgactactcacatgccctgagtcaggaaactaaaatacctcttggtctgtgtagacactttcactggatgggtagaggcctttcccacagggtctgagaagtccaccgtgatcatttcttcctttcttttagacagaattcctgggtttgtccttcccacctctatacagtctgataacgcaccggcctttattagtcaaatcacccaagaaggttctcaggctcttggtatttggaggctcctggttttacttcaaatcaccacccttaagtcgctcttgaagtcgatagaagatcttcagtggcaaggtaccctccagtactttcaccctgatgaagtcctattctttacttttatactcactcttattctggttccgttcttatgctaccctctacctctccccagctatctccaccacactatcaaactctctcttagccatttctaatccttcttaaatgaacaattgctggctttgcatttctctttcctccaaaattgccgaggcatcgacttactcactgctaaaaaaaagaggactctgtatatttttaaacgaagagtgttgtttttacctaaatcaatctggacaggtatatgacaacataaaaaaattcaaggatagaggccaaaaactcaccaaccaagcaaataattatgttgaacccccttggacactgtctaattagatgttctgggtactcccaattcttagtcctttaatacctatttttctggctgggtgtggtggctcatgcctgtaatcccagcactttgggaggctgaggtggacggatcacgaggtcatgagattgagaccatctggctaacatggtgaaacccccttctctactaaaaatacaaaaaaattagtcgggcgtggtggcgtgcacctgtagtcccagctactcaggaagctgaggcaggagaatcgtctgaaccagggaggcagaggttgcagtgagccgagatcgtgccactgcactccagcctgggcaacagagcgagactctgtctcaaaaaaaaaaaaaaaaaaaaaaaaccaacctatttttctccttcttttattcagaccttgtgtcttccgtttagtttctcaattcatacaaaaccgcatccaggccatcaccaataattctatacgacaaatgctccttctaacaactccaaaatatcaccttaccccaaaatctttcttcagcttaatctctcccaccacaggttcccacgctgcccctaatcccgcttgaagcagccatgagaaacatcgcccattatctctccataccaccccccaaaattttcgccaccccaacacttcaccactattttgttttttcttattcatataagaagacaggaatgtctggcctctgagcccaagctaagccatcatatcccctgtgacctgcatgtatacatccagatggcctgaaacaactgaagatccacaaaaaaaagcgaaaatagccttaactgatgacattccaccattgtgatttgttcctgccccaccccaactgataccatatagtctcccctgcccttaagaaggtactttgtaatattctcccccacacttaagaatgtactttgtatgcctttaagaatgtacacttataggtttgggataggtttatcccaaacctgtaagaactaatgataatcccaccaccctttgctgactcctttttctggttcagcccacctgcacccaggtgaaataaacagccttgttgctcacacaaaacctgttggtggtctcttcacatggacacgtgtga

SEQ ID NO: 263 - DNA, 965 bp, Homo sapiens
gtggggaaaagaaagagagatcagattgtaactgtgtctgtgtagaaagaagtagacacaggagacttcattttgttctgtactaagacaaattcttctgccttgagatgctgttaatctatgaccttacccccaaccctgtgctctctgaaacatgtgctgtgtccactcagggttaaatggattaagggctgtgcaagatgtgctttgttaaacaaatgcttgaaggcagcatgctccttaagagtcatcaccactccctaatctcaagtacccagggacacaaacactgcggaaggccgcagggacctctgcctaggaaagccaggtattgtccagggtttctccccatgtgatagcctgaaatatggtctcatgggaagggaaagacctgaccgtccctcagcccgacaccagtaaagggtctgtgctgaggcggattagtaaaagaggaaggaacacctctttgcagttgagacaagaggaaggcatctgtctcctgctcgtccctgggcaatggaatgtatgggtgtaaaccccgattgtatattccatatactgagataggggaaaaccgccttagggctggaggtgggacatgcgggcagcaatactgctccgtaaggcattgagatgtttatgtgtatgcatatctaaagcacagcacttagttctttaccttgtctatgatgcagagacctttgttaacgtgtttatctgctgaccttccctccactattatcctatgaccctgccacatccccctctctgagaaacaccccaaaatgatcaataaatactaagggaactcagaagctggcgggatcctccatatgctgaatgctggtcccctgggtccccttatttctttctctatactttgtctgtgtctctttcttttccaagtctctccttccacctaacgagaaatgcccacaggtgtggaggggcaacccgccctttca

SEQ ID NO: 264 - DNA, 979 bp, Homo sapiens
gtgggggaaagaaagagagatcagactgttactgtgtctatgtagaaaatggaagacacaagaaactccattttgttctgtactaagaaaaattcttctgccttgagatgctgttaatctgtaaccctagcctcaaccctgtgctcccagaaaacatgtgctgtattgactcaaggtttaatggatttagggctgtgcaagatgtgctttgttaaaaatgtgtttgcaggcagtatgcttggtaaaagtcattgccattctccattctcaagtacccagggacacaatgcactgcggaaggccgcagggacctctgcccaagaaagcctgggtattgtccaaggtttccccccactgagacagcctgagatatggcctcgtgggaaaggaaagaccttaccgtcccccagcccgacacctgtaaagggtctgtgctgaggaggattagtgaaagaggaaggcctctctgcagttgagataagaggaaggcatctgtctcctgctggtccctgggaatggaatgtctcagtgtaaaacctgatcgtacattctatttactgagataggaaaaaaccgccttatggctggaggtgagacatgctggcagcaatactgctctttactgcactgagatgttttgtaaagtcaaacataaatctggcctatgtgcacatccaggcacagcacctttccttaaacttatttatgacacacagtcctttgctcacatgttttcctgctgaccctctccctgccattaccctatagtcctgccacatccccctcaccgagatagtatagatagtgatcaataaatactgagggaactcagagaccagtgccggtgcaggtccttgcttgcggagcgccggtcccctgggcccacttttcctcatctatactttgtctctgtgtcttatttcttttctcagtctcttgtctccaccttgtgagaaatacccacaggtgtggaggggca

SEQ ID NO: 265 - DNA, 751 bp, Homo sapiens
gagagacaggactagctggatttcctaggccgactaaggattcctaagcctagctgggaaggtgaccgcatccacctttaaacaagtggcttgcaacttagctcacactcaaccaatcaggtagtaaagacagctcactaaaatgctaattaggctaaaacaggaggtaaagaaatagccaatcatctatcgcctgagagcatggtggggggggggggcggggacaatgattggaatataaacccaggcattcgagcaggaacttcaacaccctttgggtcccctcccattttatgggagctctgttttcaccctattaaatcttgcaactgcacactcttctggtccgtgtttgttatggcttgagcagagcttttgctccagtccaccactgctgtctgtggctgttgcagacctgctgctgactttggtaggatgtccgctgtgctcctgatctagccaggcgctcattgctgctcccaagcggctaaaggcttgccattgttcctgcatggctaaatgcccaggttcatcctaatcgagctgaacactagtcgctgggttccacggttctcttccgtgacccacggcttctaatagagctataacactcactgcgtggccccagattccattccttggaatctgtgaggccaagaaccccaggtcagagaacaagaggcttgctgccatcttgaaagtggcccgccaccatcttgggagctctaagaacaaggacaccctgataaca

SEQ ID NO: 266 - DNA, 438 bp, Homo sapiens
atcaggcctctgagcccaagctaagccatcgtaacccctgtgacctgcacgtatacatccagatggcctgaagcaagtgaagaatcacaaaagaagtgaaaatggccggttcctgccttaactgatgacattccaccattgtgatttgttcctgccccaccttaactgagcaattaaccttgtgaaattccttcacctggctccaaacctcccccactgagcaccttgtggcccctgcccctgcccataagagaaaaacccactttgattgtaatttttcactacctacccaaatcctataaaacagccccacccacccctatctcccttcactgactctctttttggactcagcccgcctgcacccaggtaaaataaacagccccgttgctcacacaaagcctgtttggtggtctcttcacatggacgtgcatgaaa

SEQ ID NO: 267 - DNA, 398 bp, Homo sapiens
gtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaa

SEQ ID NO: 268 - DNA, 998 bp, Homo sapiens
gtggggaaaagaaagagagatcagattgttactgtgtctatgcagaaaaggaagatgtaagaaactccattttgatctgtactaagaaaaattgttctggtttgagatgctgttaatctgtatgtaactttagccccaaccatgtgctcacagaaacgtgctgtattgaatcaaggtttaatggatttagggctatgcaggatgtgccttgttaacaatatgtttgcaggcagtatgcttggtaaaagtcatcgccattctccattctctattaaccagggacaaaatgcactgtggaaagccacagggaactctgcccaagaaagcctgggtattgtccaaagtttcccctcactgagacagcctgatatatggcctcgtgggaaaggaaagaccttacatcccccagcccgacacgcataaagggtctatgctgaggaggagtagtgaaagagggagtcctctttgcagttgagataagaggaaggcttctgtctcctgcttgtccctgggaatggaatgtctcggtgtaaagccgaccattcgttctattctgagataggagaaaattgccccgtggctggaggcgagatatgctggcagcaatactgctctgttactctttgctacactgagatatttgtgtaaagtgaaacataaatctagcctacatgcacatccaggcacagtacctttccttgaacttattcatgatacagattcctttgctcacatgtttccctactgaccttctccccaccaacactctgttgccctgccacactccccttgccaagatagtaaaaatagtgatcaataaatactgagggaactcagagaccggcgctggtgcaggtcctcgcatgctgagtgtgccggtaccctgggcccactgttctttctctatactttgtctctgtgtcttatttcttttctcaatctctcgtctccacctaacgagaaatacccacaagtgtggaggggcaggcccccttcac

SEQ ID NO: 269 - DNA, 2670 bp, Homo sapiens
tgggccaggcacaaataagcccaacccactaggaactatgttgaaaaatttcaagaaagaatttaagggagattatggtgttactgtgacaccaggaaaacttagaactttgtgtgaaataggctggccagcattagaggtgggttggccatcagaaggaagcctggacaggtcccttgtttcaaaggtatgacacaaggtaacctgtaagccaaggcaccgagaccagtttccgtacatagacagttatagctggttttagacccccttccccgcaacagtagttaagagaacagcagcataagtggctggcagaggcaaggaaagaccagcagagagaaaaaaaggccatctataccaattctaagttaatttatactaaacaaggtcttattaatagcaaaggataattgaaatctcaaacttacaaggttttcaacaaaagtgaagtttgctaaaagttaacagtgtaacatgtattatggtaacttctaatcttgtggccttagacagtctagtccaaagacataaagaaagtttgctttaaaaaaaggaaaaaaaaaagggaagaggcagaatttatataaaaaaaaagttatatggtaaattcttgtcctgaaataaattaactggttgtttaaagaaaaaaatgtttgcaataagtcaaaaagttgagacatgttaaaaaaattgcgaaagtcatgaaaaaaagttataaaaaattttatgcaaaaaatgtcgtataatttaaaagtaataaggcctcctgagtaccattgaaaaaacagtttatgtgcaaggtgtataaaaaaagtaaaatatacctttagtaaaaagattataaagaggcataagaatgtggatttttacctacattaaaaggttaaaaaaattattgttttgaaagtttaagcaagttttaaaatgttaattgtaaagaaaattctgtgtgtaaatattagctaaagttaaaaaggtatcacccagtttttctgtgaactggacactaaagtaaaaatgcaacaggtttttcttaaagcatcaacctgctctttaacaaaaattataaaaggttaaaaagagtctataaaatcttacctaatggtcaaacatgaaaaattggataaatatgtctacaaggttttattaaaattaattttaacattaataacacactaatataaaggtaaaatttaacctatctggtataaaaatcatacaagaagcattattacatataaaatggtgtttagctttctttagtctaaaaactaataaaaattggtgctaaagaaaacattcattttactagaggatcataaaagttaaagacttaaactttagcaattaagacagcataccaagatgcaaatgcctggttgaaacggatcaaatattccatctgcacgttaaacaaaagcaattgttatgcttgtgcacatggcagcccagaggccctgattgtcccccttccactaaggtggtcctccagtcgaccaggcgtgggctgcatggtagctcttttccaggattctacagcctggagtaataagtcatgccaagctctctctgctatatcccaaagtccctgcgggtcagctcccgagggccatccagcttccgtctcccaacactaagttcacttcgtgtctctcacggctgggaggagacttagcattccttggagacctgaagggatgcagtgagcttaagaattttcaagagcttatcaatcagtcagtccttgttcatccctgagtggatgtgtggcagtattgtggtggacctttactaggcactctgctgaataactagagtggcacttgtgctttagtccatttggctatccctttcaccctggcatttcatcaaccagaggaaggaaaaaataataataataataataagacatcgtaaagcaagagaagccccttataggtctttcaactctcacatctatttagatgcaattggagccccgcaaggaataccagatcaatttaaaacttgaaatcaaatagttacaggatttaagtcaatattttggtagatgacagtcaataaaaatgtagattagataaactacatctattacacccaacagcaatgaacttttcatgagttaaaaaaaaaaaaactcatgtcggccccagccctgaggctacctgacctgacaaaactctttgcactctatgtgtcaaagagaaaaaatggcagttggagttttaacccagactgtagggccctggccaaggcctatctctcaaaacaactagatgaggtttccaaaggctggcccccatgtccaagggccctggtagcaatggccctgttagcacaaaaagcagataagctaactcttagacaaaacctaaacataaagtccccccatgctgtggtgattttaataaataccaaaggacaccattagctaatgaatgctagactaactagatagcaaagcttgctctgtgaaaatccccgcataaccattgaagtttgcaacaccctaaaccccgccaccttactcctggtatcagagagcccagttaaacataactgtgtagaagtattggactcagtttattctagcaggcccaaccaccgagaccacccctaaacatcagtagactgggagttgcacgtagataggagcagctttgccaaccc

SEQ ID NO: 270 - DNA, 646 bp, Homo sapiens
cccccaggaatgtcaggcgaccatcaggtgatggtcaggtggctgctgattgtctctctaaaataataattggtcacagctggcaccagggaacgacagtctcccaatagatagaaaaaacctgaaactggtgatcggcagcttccccataaaatgtcaggagttgggcgagtgggctcaaacatgcgcactaagagacaaaatggagcattcccctggtaagggaagaacctcgagtgagcgcgtgcacaactccagtaaacacactgcgcatgctcccctccccagcgctagcaggccactactgcgcatgcggacagcccaccccaagggaagaaagggaagaatcgtggggagaagcaacgcaagaccccggaagcatgccaacgtgtaaaaccccaagtcaaaggtcaaacagtgcactggatctctcaagtcgcctgcttggccctctactaagtatgttttacgttctttcattcctgctttaaagcttttcagtaaactttcatgcctgctctaaaacttgcctcagtctctccttctgtcttgagcccctctgccaaattctttcttccgaggaggcaagtattgagattgctgcagacccgtgatgattcactgctggtgacatactttggtgcca

SEQ ID NO: 271 - DNA, 6209 bp, Homo sapiens
gtcaggcctctgagcccaagctaagccatcatatcccctgtgacctgcacgtacacatccagatggccggttcctgccttaactaatgacattccaccacaaaagaaatgaaaatggcctgttcctgccttaactgatgacattatcttgtgaaattccttctcctggctcatcctggctcaaaagctcccctactgagcaccttgtgacccccacccctgcctgccagagaacaacccggctttgactgtaattttcctttacctatccaaatcttataaaacggccccacccctatctcccttcgctgactctcttttcagactcagcccgcctgcacccaggtgattaaaagctttattgctcacacaaagcctgtttgatggtctcttcacatggatgtgtatgaaatttggtgccgtgactcggatcgggggacctcccttcagagatcaatcccctttcctcctgctctttgctccgtgaaaaagatccacctacgacctcgggtcctcagacccaccagcccaaggaacatctcaccaattttaaattgagtaagcggcctcttcttactctcttctccaacctctctcactatccctcagccactttctcctttcaatcttggtgccacccttcaatctctcccttctcttaatttcaattcctttcattttctggtagagacaaaggagacacattttatctgtggacccaaaactccggcgctagtcacggactcgggaaggtagccttcccttggtgtttaatcattgcagggacgcctctctgattattcacccacgtttcagaggtgtctgaccatgcagcgacgcctgccttggtctttcacccttagcggcaagtcccgcttttctgggggaggggcaggatccctgaccccttctctccctgtctctaccccttttctacttttctggggggcaagaaccccctgatcccttatttccacaccgaccccttatctctgtgccccgatcccttatttccatgtcctgaccccttatctctgcaccccgatcccttatttccacatccactcccagatcccttatttctgtgccccgacctcttatctctgcaccccaaccccttatttctgcatcctgacccctttcccgcttttctggatggtaagaacccccgaaccccttccctccatgtctctactcccccttttctttagacttgcctccttcactataggcaaccttccactttccattcctccttcttctcccttagcctgtgttcttaagaacttaaaacctcttcaactctcacctgacctaaaacctaaatgccttattttcttctgcaatgccagttgaccccaatacaaactcgacagtggttccaaacagccagaaaatggcactttcattttttccatcctacaagatctagataactcttgttgtaaaatgggcaaatggtctgaggtgcctgatgtccaggcactcttttacacatcagtcccttcctagtctctgttcccaatgcaactcatcccaaatcttccttctttccctcccgcctgtcccctcaatcccaaccccaagcgtcgctgagtctttctaatcttccttttctacagacccatctgacatctcccctcccaattcttcctcagcctcccctcctccaccctataatccttttatcacctcccctcttcacacccggtctggcttacagtttctttcctcaactagctctcccccacctgcccagcaatttcctcttaaaaaggtggctggagctaaaggcatagtcaaggttaatgcttctttttctttatttgacctctcccagatcagttagcgtttaggctctttttcatcaaacaggaaaaacccagcccagttcatggctcatttggcagcaaccctgagacgctttacagccctagaccctaaaaagtcaaaaggccgtcttgttctcaatatacattttattacccaatccactcccgactttaaataaagctccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggtgttcctccagaacctcctcccacaggagcttgctacaagtgctggaaatctggctactgggcaaaggaatgcctgcagcccaggattcttcctaagccacattccatctgtgtgggaccccccctgaaaatctgactgttcaacttacctggcagccactccaagagctcctgggactctggcccaaggctctctgactgactccttcccagatcttctcagcttaacggctgaagactgacactgcctgatcgcctcggaagccccctaaaccatcacggatgccgagtttcaggtaactctcacagtggaaggtaagtccatccccttcttaatcaatacgaaagctatccactccacattaccttcttttcaagggcctgtttcccttgcctccgtaactgttgtgggtattgatggccaggcttctaaacctcttaaaactccccaactctggtgccaacttagacaatactcttttaagcactcctttttagttatccccacctgcccagttcctttattaggctgagacactttaactaaattatctgcttccctgattattcctgggctacagccacacctcattgccgccttttcccccattcaaagcctccttcatatcctccccttgtatctccccatcttaacccacaagtataagacacctctactccctccttagcgaccgatcatgcaccccttaccatcccattaaaacctaattacgcttaccttgctcaatgccaatatcccatcccatagcacactttaaaaggattaaagtctgttatcactcacctgttacagtatggccttttaaagcctataaactctccttacaattcccccattttacccgtcctaaaaccagacaagacttacaggttagttcaggatctgcaccttatcaaccaaattgttttgcctatccaccccgtggtgccaaacccatatactctcctatcctcaatacctccctctacaacccattcttctgttctggatctcaaacattgctttctttaccattcctttgcacccttcatcccagcctctcttcgctttcacttggactgaccctgacacccattaggctcagcaaattacctgggctgtactgccgcaaggcttcacagacagcccccattacttcagtcaagctcaaatttcatcctcacctgttacctttctctgcataattctcgtaaaaacacacgtgctgtccctgccaattgtgtccgactaatctcccaaacctcaatcccttacaaaacaacaactcctttccttcctaggcatggttagcgcggtcagaattcttacaaaagagccgggaccgcaccctgtagcgtttctgtccaaacaacttgaccttactgtttcagcctagccctcatgtctgcgtgcagcagctgccgctgctttaatacttttagaggccctaaaaatcacaaactatgctcaactcactctctacatttctcataacttccaaaatctattttcttcctcatacctgacacatatactttctgctcccccgctccttcagccatactctttgttgagtctcccacaattaccattgttcctggcatggacttcgatctggcctcccacattattctggataccacacctgaccctcatgactgtatctctctgatccacctgacattcaccccatttccccatatttccttctttcctgttcctcaccctgatcacatttagtttattcatggcagttctgccaggcctaatcgccactcaccagcaaaggcaggctatgctagagtatcttccacatctatcactgagtctatcgctctgccccccctccactacctctcagcaagccaaactagttgccttaactcaagccctcactcttgcaaaaggactacacatcaatatttatagtgactctaaatatgcctttcatattctgcaccaccatgctgttatataggctgaaagaggtttcctaactatgcaatggtcctccattattaatgcctctttaataaaaactctgctcaaggccgctttagttccaaaggaagctggagtcattcactgcaaaggccatcaaaaggcgtcagatcccattgctctagacaacgcttatgctgataagatggctagacaagcagctagctttccaacttctgtatgtcacgccagtttttctccttcacatcagtcactcccacctactcccctgctgaaacttccacctatcaatctcttcccacacaaggcaaatggttcttagaccaaagaaaatatctccttccagcctcacagtcccattctattctgtcatcatttcataacctcttccacataggttacaagccactagcccgtctcttagaacctctcatttcctttccatcctggaaatctatcttgaaggagatcacttctcagtgttccatttgctattctactacccctcagggattgttcaggcctcctccctttcttacacatcaagctcggggatttgccccagcccaggactggcaaattgactttattcacatgccccgagtcagaaaactaaaatatctcttagtctgggtaggcacttccactggatgggtagaggcctctcctacagggtctaagaaggccactgcagtcatttcttccctactgtcagacataattcctctgtttggccttcccacctctatacagtccgatagcagaccggcctttattactcaaatcagccaagcattttttcaggctcttggtattcagtgaaacctttatatcccttacggtcctcagtcttcaggaaaggtagaatggacaaatggttttttaaaaacacacctcaacaagctcggccaccaacttaaaaaggactggacaatacttttagaactttcccttctcagaattcaggcctgtccttggaatgctacagggtacagcccatttgagctcctgtatggacgctcctttttattaagccccagtctcattccagacaccagaccaacttggactgtgccccaaaaatcttgtcatcctatcttctgtctagtcgtactcctattcaccattctcaactactcatacatgccctgctcttgtttacactgctggtttacactgtttctccaagccatcacagctgatatctcctggtgctatcctcaaactgccactcttaactcttgaagtaaataaataatctttgctggcaggactatgctgaatctccttaggcactctctaattagatgtcctgggtcctcccaattcttagatctttaatacctgtttttctcctctcttattccgtttagtttttcaattcatacaaaaccgtatccaggccatcaccaataattctaaatgacaaatgtttcttctaacaaccccacaatatcaccccttaccacaaaatcttccttcagcttaatctctcccactctaagttcccacgccacccctaatcccactcgaagcagccctgagaaacatcgcccattatctctccatatcatcccccaaaattttcgctgccccaacactttaccactatttcattttatttttcttgttaatataagaagacaggaatgtcaggcctctgagcccaagctaagccatcatatcccctgtgacctgcatgtacacatcaagatggccggttcctgccttaactgatgactttccaccacaaaagaaatgaaaatggcctgttcctgccttaactgatgacattgtcttgtgaaattccttctcctggctcattctggctcaaaagctcccctactgagcaccttgtgacctccatccctgcccaccagagaacaaccgccctttgactgtaattttcctttacttactcaaatcttataaaacagccccaccccatctccctttgctgactctcttttcggacttagcccgcctatacccaggtgattaaaagctttattgctcacacaaagcctgtttggtggtctcttcacatggacgtacatgaaa

SEQ ID NO: 272 - DNA, 3685 bp, Homo sapiens
gtcaggcgtctcagcccaagccaagccatcgcatcccctgtgacttgcatgtatacgcccagatggcctgaagtaactgaagaatcacaaaagaagtgaatatgccctgccccaccttaacagatgacattccaccacaaaagaagtgtaaatggccggtccttgccttaagtgacgacattaccttgtgaaagtccttttcctggctcatcctgtctcaaaaaacacccccactgagcaccttgcaacccctactcctgcccgccagagaacaaaccccttttgactgtatttttcctttacctacccaaatcctataaaacagccccacacttttctcccttcactgactccctttttggattcagcccacctgcactcaggtgaaataaacagccatgttgctcacacaaagcctgtttggtggtctcttcacacggacgcacatgaaatttggtgccgtgacttggatcgggggacctcccttgggagatcaatcccctgtactcctgttttttgctccgtgagaagatccacctatgacctcaggtcatcagaccgaccagcccaaggaacatctcaccaattttaaatcaggtaagcggcctcttcttactctcttctgcaacctctctcactgtccctcaaccactttctcctttccactcttcaatctctcccttctcttaatttcaattcctttcattttctggaagagacaaaggagacacgttttttccatggacccaaaactccggcactggtcacggactgggaaggcagccttcccttggtgtttaatcattgcagggatgcctctctgattatacacccacgtttcaagggtgtctgaccatgcaggaacacctgccttggtcattcacccttagcggcaattcccgcttttctggggaaggggcaagtacctcaactccttctcgccttgtctctaccccttctctgcttttctgggagaggggcaagtacccttcaaccccttctccttcacccttagcggcaagtcccgcttttctatggggcaagaacacccaatcccttatttccacgccccagcctcttatctctgcaccccaatcccttatttccatgccccaacctcttatctctacaccccaatcccttatttccatgccccaacctcttatctctacaccccaatcccttatttctgcactccaacctcttatctctgtgccccaatcccttatttcagtgcctcaacctcatatctctgcaccccaatcccttatttccatgccctgacctcttatctctgtgccccaaccccttttcccacttttctggaaggtaagaacccccaaaccccttccttccatttctctactctctcttttctctaggcttgcttccttcactatgggcaaccttccatgctccattcttccttctactcccttggcctgtgttctcaaaaacttaaaacctcttcaagtcacacctgacataaaacctaaatgccttatgttcttctgcaatgccacttgaccccaatacaaactcgacagtagttccaaatagccagaaaatggcactttgaatttttccatcctacaagatctaaataattcttgttgtaaaacaggcaaatggtctcaggtgcctgacgtccaggcattcttttacacatcagtcccttcctagtctctgtgcccagtgcaactcatcccaaatcttccttctttccctcccgcctgtcccctcagtaccaaccccaagtgtcgctgagtctttctaatcttccttttctacagaccaatctgacatctcccttcctccccaggctgctcctcaccaggccaagctacgtcccaattcttcctcagcctctgctcctctaccctataatctttttatcacctcccctcctcacacctggtccggcttacagtttccttccgtgactagccctcctccacctgcccagcaatttactcttaaaaaggtggctggagccaaagatatagtcaaggttaatgctcctttttctttatcccaaatcagaagtgtttaggctctttttcatcaaatataaaaacccagcccagttcatggctcatttggcagcaaccctgagacactttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggcgtacaataacagaaaaaagttgcaattctttgcctccactgtgagacaaaccccagccacatctccagcacacaagaacttccaaatgcctgaaccacagcagccaggcagtcctccagaacctcctcccccaggagctagctacatatgcaaaatctggccactgggccaaggaatgcccacagcctgggattcctcctaagccgcgtctcatctgtgtgggaccccactgaaaaccggactgttcaactcacctggcagccattcccacagcccctggaactctggcccaaggctctctgactgactccttcagagatcttctccgcttagtggctgaagactgacactgcccgatcgcctcagaagccccctagaccatcacggacgctgaacttcgagtaactctcacagtggcgggtaattccgtccccttcttaatcattacggtggctacccactccacattaccttcttttcaagggcctgtttcccttgattccataactgttgtgggtattgatggccaggcttctaaacctcttaaaactccccaaccctgctgccaatttagacaatactcttttaagcactcctttttagttatccccacctgcccagttcccttattaggccgagacaatttaactaaattatctgcttccctgactattcctggactacagctatatctcattgccacccttcttcccaatccaaagtctcctttgcgtcctcttgtatcccccgaccttaacccataagtataagatacctctactccctccttggtgaccgatcatgcaccccttaccatctcattaaaacctaatcacccttaccccactcaacaccaatatcccatcccacagcatgctttaaaaagattaaagcctgttatcactcgtctgctacagcatggccttttaaatcctataaactctccttacaattcccccattttacctgtcctaaaaccagacaagccttacaagttagttcatgatctgcaccttatcaaccaaattgttttgcctatcccccctgtggtgtccaacccgtacactcttttgtcctcaataccttcctccacaactcactattctgtgcttgatcttaaagatgctttttcactattcccctgcaccccttgtcccagcctctctttgcttccacttagactgaccctgacacccatcaggctcagcaaattacctaggctgtactgccgcaaggcttcatagacagcccctattacttcagtcaagcccaaatgtcatcctcatctgttacctatctcagcatagttctcatgaaaacatatgtgctttcccttgctgatcatgtccgattaatctcccaaaccacaatcccttacaaaacaactcctttccttcctaggcatagttag

SEQ ID NO: 273 - DNA, 963 bp, Homo sapiens
gtgtgggaaagaaagagagatcagactgttactgtgtctgtgtagaaagaagtagacgtaagagactccattttgttctgtactaagaaaaattcttctgccttgagatgctgttaatctgtaaccctacccccaaccctgtgctccctgaaacatgtgctgtgtcaactcagggttaaatggattaagggctgtgcaggatgtggtttgttaaacaaatgcttgaaggcagcatacttgttaagagtatcaccactccctaatctcaagtacccagagcacaatacactggagaaggccgcagggacctctgcctaggaaagccaggtactgtccaaggtttctcccatgtgatagtctgaaatatggcctcgtgggaagggaaagacctgaccatcctccagcccgacccccataaagggtccctgctgaggaggattagtaaaagaggaaggaaggcctctttgcagttgagataagaggaaggcatctgtctcctgctcctccctgggcaatggaatgtctccctgtaaagcccgattgtatattccatctactgagataggggaaaactgccttaggggtggaggtgggaaatgctggcagcaatactgctgtttaaggcattgagatgtttatgtatatgcacatcaaaagcacagcactttttatcttgtttatgatgcagagacatttgttcacatgttttcctgctgaccttctctccactattaccctattgtcctgccacatcccctctccgagaaacacccgataatgatcaataaatactaagggaactcagaggccagtgccggcgcgggacctccgtatgcgaacgccggtcccctgggcccatttttctttctctatactttgtctctgtgtctctttcttttccaagtctctcgttccacctgatgagaaacgcccacaggtgtggaggggcaacccaccccttca

SEQ ID NO: 274 - DNA, 2155 bp, Homo sapiens
tgcggtcagaattcttacacaagagccaggaccgcaccctgtagcctttctgtccaaacgacttaaccttactgttttagcctagccctcatgtctccatgcagcggctgctgccgccctaatacttttagaggccctaaaaatcacgaactatgctcaactcactctctacatttcttataacttccaaaatctattttcttcctcatacctgacgcgtatactttctgctccccggctccttcagctgtactcactctttgttaagtcccacaattaccattgttcctggcgtggacttcattctggctcccacattactcctgataccacacctgacccccatgcctgtatctctctgatccacctgacattcaccccatttccccatatttccttctttcctgttcctcaccctgatcacgcttgatttattgatggcggttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgccccaagtcagagaactaaaatacctcttagtctaggtagacactttcactggataggtagaggcctttcctacagggtctgagaaggccaccgcagtcatttcttcccttctgtcagacctaattcctcagtttagctttcccatctctatacagtctgataacagactagcctttattagtcaaatcagccaagcagtttttcaggctcttggtattcagtgaaacctttatatcccttacagtcctccgtcttcaggaaaggtagaatggactaatggtcttttaaaaacacacctcaccaagctcagtcaccaactttaaaaggactggacaatacttttacctttttcttttctcagaattcaggcctgccctcggaatgttacagggtacggtccatttgagctcctgtatggatgctcctttttattaagccccagtctcatttcagacaccagaccaacttagactgtgccccccaaaaaacttgtcatccctactatcttctgtctagtcatactcctattcaccattctcaactactcatacatgccctgctcttgtttacactgctggcttacactgtttttccaagctgtcacagctgatatctcctggtgctatccccaaactgccactcttaactcttgaagtaaataaataatctttgctagcaggactatgctgaatctccttaggcactctctaattagatgtcctgggtcctcccaattcttagacctttaatacctgtttttctcctcctcttattccgtttagtttttcaattcatacaaaaccgtatccaggccatcaccaataattctaaatgacaaatgtttcttctaacagtcccacaatatcaccccttaccacaaaatcttccttcagcttaatctctcccactctaggttcccgtgccgcccctaatcccgctcgaagcagccctgagaaacatcgccaattatctctccataccatcccccaaaattttcgccatcccaacgctttaccactatttccttttatttttcatattaatataagaagacaggaatgtcaggcctctaagcccaagctaagccatcatatcccctgtgacctgcacttacacatccagatggccggttcctgccttaactgatgacattccaccacaaaagaaatgaaaatggcctgttcctgccttaactgatggcattatcttgtgaaattccttctcctggctcatcctggctcaaaagctcccctactgagcaccttgtgacgaccactcctgcctgccagagaacaacccccctttttcctttacctacccaaatcctataaaacggccccgcccctatctccctttgctgactctcttttcggactcagcccgcctgcacccaggtgattaaaagctttattgctcacacaaagcctgtttggtggtctcttcacacagatgcgcatgaaa

SEQ ID NO: 275 - DNA, 970 bp, Homo sapiens
gtggggaaaagaaagagagatcagactgttactgtgtctatgtagagagaagtagacataagagactccattttgttctgtactaagacaaattcttctgccttgagatgctgttaatctgtaaccctaccgccaatgctgtgctccctgaaacatgtgctgtgtcaactcagggttaaatggattaagggctgtgcaggatgtgctttgttaaacagatgcttgaaggcagcatgctccttaagagtcatcaccactccctaatctcaagtacccagagacacaaacactgcggaagcccgcagggacctctgcctaggaaagccaggtattgtctaaggtttctccccatgtgatagtctgaaatatggcctcgtgggaagggaaagacctgaccatcccccagctcgacacccataaacggtctgtgctgaggaggattaatagaagaggaaggaaggcctctttgcagttgagataagaggaaggcatctgtctcctgctcgtccctgggcaatggaatgtctcggtgtaaagcccaattgtatattccatctactgagataggggaaaaccgcttagggctggaggtgggatatgctggcagcaatactgctctttaaggcattgagatgtttatgtatatgcacatcaaaagcacagcacttttttctttaccttgtttatgaggcagagacatttgttcacatgttttcctgctgaccctctccccactattcccctattgtcctgccacattcccctttccgagaaacgcctgataacgatcaataaatactaagggaactcaaagactggtgctggcgcgggtcctctgtatgctgagcgccagttccccgggtccacttttctttctctatactttgtctccgtgtctctttcttttctcaagtctcgttccacctgatgagaaacgcccacaagtgtggaggggcaggccaccccttca

SEQ ID NO: 276 - DNA, 606 bp, Homo sapiens
ccatcaggtgagatggtcaggtggttgttacactgtctctctaaaataattggtgacagccggtgccagggaaaggcaggctcccaacagacagaaaacacctgaagctggtgatcagcagctttcggataagagctcaggatttgggtgcgtgggctgaagcatgcgcattaagaggcaaaaggacggcgcttgactggtataggaccttctaggaacattcaactagtaagggaagaacacctcaagtgagcatgcgcacaactccagtaatacactgcgcatgcgccccctcccaagcgctggcaggcctctgcgtatgtggacggccaaccccaaggaagaatcaggggagacctcggaaaaatgcccacgtataaaaccccaggtcaaaggtcaaactgtgcacttgctctctcaagccgcctgcttggccctcttccaagtgtacttcctttcgttcctgttctaaagctttttaataaactttccctcctgccctaaaacttgcctccgtctctcctgctgtcttatgcccctcgcttgaattctttcttctgaggaggcaagaattgaggttgctgcagacccgttatggattcacca

SEQ ID NO: 277 - DNA, 999 bp, Homo sapiens
ataggtagccagtcagacatgaacagggcgggagaggcacccccacaaccaactaagaatgtcaggtgaccatcaggtgatggtcaggtggttgttaacagtctctctaaaataataacttgtcacagctggcagggaaaagcagtctccctaaagatagaaaaaacctgaaactggtgatcagcaacttcctgataagatctcaggagttgggcaagtgagctcaagcatgcacactaaaaggcaaaatggcagagttaaactggtatatgacctcctaggggcatttagctggtaagagaagaatgccttaaatgagcaggtgtacaactccagtaaacacactgcgcatgctcccctccgaagtgctagcaggccatcgcacatgcggacaccccaccccaagggaggaatcgggagaagggatgaaagatcccagaagcatgccaacgtataaatccccaagtcaaaaggtcaaactgcgcacttgtctttcaagttgcctgcttggccctcttccaagtgtatttccttccttttgtttctgctctagagttttttgtttgttttgttttgagatgaagtcttgctcttgtcccccaggctggagtgcgatggtgcgatctcagctcaccgcaacctctgcctcccaggttcaagcaattctcctgcctcagcctcccgagtagctgagattacaggcgcctgccaccatgcccggctaatttttgtatttttagtagagatggggtttctccatgttggccaggctggtctcgaaatcctgacctcagttgatccgccggcttcagcttcccaaagtgctgggatttcaggcgtgagccaccgcacccggtctctgctctagagtttttaaataaactttcactcctgttctaaaacttgcctccgtctcttctgctttatgcccttcagttgaattctttcttctgaggaggcaagaattgaggttgcttcagaccccctacagatttgcca

SEQ ID NO: 278 - DNA, 2132 bp, Homo sapiens
ttatagtgggtagctagtcaggcatgagcggggcaagagagggctccccacaacccccaccaaaaatgtcaggggctcatcaggtgatgttcaggcagtgctgtttctctaaaataattggttgcagccaatgccagggaaaggcagtctcccaacagacagaaaaaacctgaaactggtgatcagcagcttcatgataagatattaggagttgggcgactgggctcaagcatgcacattgaggcaaaatggtgtagttgaactggtatatgacctcctagggacatctgactggtaagggaagaattcctcaagtgagcatgcctacaactccagtaacacactgtgcatgctcccctcccaagcgctagcaggccaccatacatgcagacagcccaccccaagggaagaatcaggggagaacgaacgcaagaccctggaattatgcaaacatataaaaccctaagtcaaaaggtcaaaccacgcactgatatttcaagtcacccacttggccctcttccaagtggactttccttccctttgtaacttctctaaagcttttaaacaaactttcattcctgttccaaaacttgccttgatctctcctgccttccatctcctcagtcaaattcttccttctgaggaggcaagaactgaggttgctgtagacctgtatgaatttgccactgctaacatactttggtgctatatgactcggataagttccctagtagtacaagacctatacaccttgcctgcttcagctggaggcattcaacccgtctacatggtttcctcctcctttttgctctcttgcttactaaccaaccccacaaacaattcctctcagctacagtggctctactccccccagctgatctctcagcttaccctgatgggtagctcacgggagtgggaaggaccttggggtccacactgagtagaactaatggccctcctgggcaggaggctcatgaaagtggtagggctaaagtctaaaactgtgcaatgtctgggttttcctctgctttttcaactaaaatcagcttttccccaagaacctgcactgcctattcttctattttctctgtgtgttctgaaatggccttgaacacccagccagacagtctgccttgggggcaagtctggctctttgctttcacttcacatgccacatgacttcttaaacacacactccctgttattcatgtgtccgcggctcttgctgaattttcatggcagaaaagacacaggctcctttgcagatagcccctgagatttatacttgtttttatcctaccagctcagatgacctccaacccttcccctgtctgctggcacattgctgggacagacactaattggaactgtagctctgccagctccttataacttactatatgctttttgttcctgttacaccccagggccaagttttccagtggcttttgaagcaatttgtctgcctacataggacctcactctggccctttaaggatcccacctacttgcctacttgctttttttttttttttttttttttttttttttttttttttagtaagcacccactgggaggaggataaattcttcctttgccatttgcgagttcttaccccaagccccaagtcccctggagtttactcctttatgtcaagagggcaaataaatgttgcccccttgaatccaagggctgctgtttttgtgaggatatgaaggctttccatgagtattcctcttgcttcctcccacttcctcctgtagcttccatttctctaaccacttccatgcccttattaacatacatcaagaccttcaaggtcatatttgcagggagggaagtctagccccttggggcagttaactgaaaaacaggcttctcatctacttaaagaacatggaaatgggaatataagaaaatagataatcattttgttgctaaatgctgaagtgagagtcactatagggtcatggagacaaggatataggctggcccaaggcagcaggtgcaagagacccattggacagagatgaagtttagccctaggctaacagattaccattagaacagagatgaaggcaaggttaggggtacacagtaagaccagttcattccagaaccttagggacga

SEQ ID NO: 279 - DNA, 566 bp, Homo sapiens
tacagtagatggttagtcagatatgagcagggcaggaaagagggccccaggtcaccaggaatgtcagggaccatcaggtgacggtcaagccctcgttaagctaaaataataattgggcacagccagtgccagggaaagtgagtctcccaacagacagaaatacctgaagcttgaagctggtgatgagaagcttcccaataaaatctcaggagtcagacaactggactcaagcatgagcactagaggcaaaaccgtggaacttagctggtagaggaccttcctctaggaactcgactgggaagggaaaaatgcctcaagtgagcatgtgcacaactccagtaaattcactgtgcatgtggtccctcccagatgctggcaggccacggcacgtatggacagcccaccccaagggaagaatcaggagagaagggatgtaacccccccagaagcaggtcaatgtataagaccccaactcaaatgtcaaatggcacacttgatctctcaagttgccggcttggccctcttccaaatgtattttacttcttttcattcccactctaaaactt

SEQ ID NO: 280 - DNA, 479 bp, Homo sapiens
ttacagtaggtggctagtcaggcatgaatggggcaagagagggctcccccatcaccccatcagaaaagtcgggtgaccatcaggtgatggtcagacagttgtcacactgcctctaaaataataattggtcgcagccagtgccagggaaaggcagtttccctatagacaggaaaaaactgaaactggtgatcagcagcttcctgatgagatcttaggagctgggcaagtgggctcacacatgtgcactaagaggcaaaacggtggaatttaactggtatatgaccttccgcgcccattccacggcaaaagggaagaatgcctcaggtgagcatgcgtacaactccagtaaacacaccgtgcatgctcccctcccaagcactagcaggccactgtgtatgtggacaacccacaccaagagaagaatcaggggagaaggaacgcaagacccagaatcacgccaacatataaaaccccaagtc

SEQ ID NO: 281 - DNA, 5781 bp, Homo sapiens
gtcaggcctctgagcccaagctaagccatcatatcccctgtgtcctgcacgtacacatctagatggccggttcctgccttaactgatgacattatcttgtgaaattccttatcctggctcttcctggctcaaaagctcccctactgagcaccttgtgacccccactcctgcctgccagagaacaacccacctttgactgtaattttcctttacctacacaaatcttataaaatggcgccacccctatcgccctttgctctcttttcagactcagcccacctgcacccaggtgattaaaaagctttattgctcacacaaagcctgttggtgggctcttcacatggacacgagtgaaatttggtgccatgactcggatcaggggacctcccttgggagatcaatcacctgtcctcctgctctttgctccatgagaaagatccacctatgacctctggtcctcagaccaaccagcccaaggaacacctcaccaattttaaatctggtaagtggcctctttttactctcttctttaacctctctcactatccctcaacctctttctcctttcaatcttggtgccacactttgatctctcccttctcttaatttcagctcctttccttttctggtagagatggcgacgcgttttgtttgtggacccaaaactccgacacccgtcatggactcgggaagacagtcttcctttgttgtttaatcatgcgaggatgcctgcctgattattcacccacgtttcagaagtgtctgaccacacggggatgcctgccttggtccttcacccttagcaacaagtaccactttaatggggggcaagaaacccccaaccccttctctccatgtctctaccccttctctgcttttctagggggcaagaaccccccaaccccttctccttcacccttagtggcaagtaccacttttctagggggcaagaacaccccaaccccttctctccatgtctctaccccttctctgcttttctgggggacaggaaccccccaccccttctctccatgtctctactctctcttttctctgggcttgcctccttcactatgggcaagcttccgccctccattcccccttcttctcccttagcctgtattcttaaaaacctaaaacctcttcaactcacacctgaccaaaaacctaagtgccttattttcttctgcaatgctgcttgaccccaatacaaacttgacagtagttccaaatagccagaaaatggcactttcaatttttccatcctacaatatctaaataattcttgtcataaaatgggcaaacagtctgagatgcctgatgtccaggcattcttttacacatcagtccctccctagtctctgttcccaatgcaactcatcccaaatcttccctctttccctcccatctgtcccctcagtcccaacctcaagcatcgcagagtctttctaatcttccttttctacagacccatctgacctctcccctccttgccaggctgagctagttcccaattcttcctcagtctctgctcctccaccctataatccttttatcaccttcactcctcacacagggtccagcttacagtttcgttgtgactagccctccccaacctgcccagcaatttcctcttaaagaggtggctggagctaaaggcatagtcaaggttaatgctcctttttctttatcccaaatcagacagcatttaggctcttctccatcaaatgtaaaaacccagcccagttcatggctcatttggcaacaaccctgagatgctttacagccctagtccctaaaaggtcaaaaggctgtcttattctcaatatacattttattacccaatcggctcctgacattaaataaaactacaaaaattaaattctggccctcaaaccccacaacaggacttaactaacctcaccttcaaggtgtacaataatggagtagacacagccaagtagtaacatatttctgagttgcaattccttgcctccattgtgagacaaaccccagccacatctccagcacacaagaacttccaaatgcctaaaccacagtggccaggcattcctccaggcctgcctccctcaggagcttgctacgagtgccagaaatctggccaccagaccaaggaatgcccgcagtccaggattcctcttaagccatgtcccatcaatgtgggaccccactgaaaatcggactgttcaactcacctggcagccactcccagagcccctggaactctggcccaaggctgtccgactgactccttcccagatctttttggcttagtggctcaactctgatgctgcccgatcacaatagaagccccctagaccatcacggatgccaagcttcaggtaactttcacagtggtaggtaagtccatccccttcttaatcaatatggagactacccactccacattactttcttttcaagggcctgtttcctttgcctccataactgttgtaggtattgacgaccaggcttctaaacctcttaaaactccccaactctggtgccaacttagacaatactctttaaagcactcctttttagttatcaccacctgtccagctcccttattaggtcgagacattttaactaaattatctgcttccctgactattcctgggctacagccacacctcattgccaccttttaccccagttcaaagcctccttcacatcctctccttgtatctccccactttaaaccacaagtataggacacctctacatcctccttagcgacccatcatgcacctcttaccatctcattaaaacctaatcacccttaccccactcaatgccaatatcccatcccacagcatgctttaaaaggattaaagcctgttatcattcgcctgttacagcatggccttttaaagcctataaactctccttacaattcccccattttacctgtccaaaaaccggacaagccttacaggttagttcaggatctgagccttatcaaccaaattgttttgcctatccaccccatggtaccaaccccatatactctcctatcctaaatacctccctccacaaacccattattttattctggatctcaaacatgctttctttactattcctttgcaccattcaccccagcctctcttcgctttcacttaactgaccctgacacccatcaggctcagcaaattacctgggctgtactgccacaaggcttcacagacagcccccattacttcagtcaagcccaaatttcttcctcatctgttacctatcactgcataattctcataaaaacacatgtgctctccctgctgatggtgtccagctaatctcccaaatcccaatcccttctacaacatagcaactcctttccttcctaggcatggttagtgtggtcagaattcttacacaagagccaggactgcaccctgtagcctttctgtccaaacaacttaacctcattgttttagcttagccctcatgtctgtgtgcagtggctgccactgccttaataattttagaggccctcaaaatcacaaactatgctcaactcactctacagttctcataacttccaaaatctattttcttcctcacacctgatgcatatactttctgccccactccactaactctcagaaagtcgaactcattgccttaactcgagcactcactcttgcaaaaggactacacatcaatatttgtactgactctaaatatgccttccatatcttgcaccaccatgctgttatataggctgaaagagatttcctcaccacctttgcatagtggcaaagtcctccatcattaatgcctctttaataaacactctactcaaggctgctttacttccaaaggaaaccgaagtcattcactgcaagggccatcaaaaggcattgctctaagcaaggcttatgctgataaagtggctagacaagcagctagcttccaacttctgtccctcacggccagtttttctccttcacatcggtcactcccacctactcccctgctgaaacttccacctatcaatctcttcctacacaaggcaaatggttcttaggccaaggaaaatatctccttccagcctcacaggcccattctattctgtcatcatttcataacctcttccatgtaggaagctgctagcctgtctcttagaacctctcatttcctttccatcctggaaatttattctcaaggaaatcacttctcagtgttccatctgctagtctactaccactcagggattgttcaggcctcctccctttcctatacatcaagctcggggatttgcccctgcctgggactggcaaattgactttactcacatgccctgagtcagaaaactaaaatctggatagacactttcactggatgggtagaggcctttcctacagggtctgagaaggccaccacagtcatttcttcccttctgtcagacataattctttggtttggccttcccacctctatacagtctgagagcagactgacctttattagtcaaatcagccaagcattttttcaggctcttggtattcagtgaaacctttatatcccttacggtctgcagtcttcaggaaaggtagaacgaactaatggtcttttaaaaacacacctcaccaagctcaaccaccaacttaaaaaggactggacaatacttttaccactttcccttctcagaattcaggcctgtcctcagaatgctacagggtacagcccattcgagctcctgtatagacactcctttttattggccccagtctcattccagacaccagaccaacttagactgtgccccaaaaaacttgtcttccctactatcttctgtctagtcacactcctattcaccgttctcaactactcatacatgccctgctcttgtttacactgccagtttacactgtttcttcaagccatcacagctgatatctcctggtgctatcctcaaactgccactcttaactcttaaagtaaataaataatctttgctggcaggactatgctgaatctccttaggcactctctaattagatgtcctgggtcctcccggttctcagacctttaatacctgtttttctccttctcttattccgtttagtttttcaattcagacaaaaccttatccaggccatcatcaataattctaaatgactaatgtttcttctaacaaccccacaatatgaccccttaccacaaaatcttccttcaccttaatctctcccactctaggttcccacgccgccccaatcccactcaaagcggccctgagaaacattgcccattatctctccataccacctgcaaaaatttttaccgtccaacactttaccatgatttcattttatttttcttattaatataagaagacaggaatgtcaggcccctgagccgaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcattctggctcaaaagctcccctactgagcaccttgtgacccccactcctgcctgtcagagaacaacccccctttgactgtaattttcctttacctactcaaatcttataaaatagccccaccccatctcccttctctgactctcttttcagactcaacccgcctgtgcccaggtgattaaaaagtgtattgctcacacaaagtctgtttggtggtctcttcacacagacgcgagtgaaa

SEQ ID NO: 282 - DNA, 700 bp, Homo sapiens
ttacagtagatagtagggcagagatgagcaggatgggagacggccctctcacctcccaaggaatgtcagaggactatcaggtgatgttcaggaggttgttaaactgtctctctaaaatagtaattggtcacagccaaatccagggaaaggtcagtctcctaataggtagaatctggtgattagcagtttcctgataagatctcaggagttgggtgattgggctcaaggatgtgcagtgcaaggcaaaatggtggagtttaactggtctatgaccttcctctaggaatgctcgactggtaaggggaaaagcacctcaagtgagcatgtgcacaacttcagtaaacacactgcgcatgcagcccctcccaagtgctagcaatgccactgcacatgcagacagcccaccccaagggaagaatcagagaagagacgcaagacccctgaaccatgccattgtaaaaccccaagtcaaaggtcaactgtacacttgaatctctcaagttgcccgcttgaccctcttccaagtgtaatttacttcttttcattcctgctgtaaaactttttaataaactttcactactggtttcaagcttgcctcagtctctcatgtgctttatgccccctcggttgaattctttcttccgaagaagcaagaattgaggttgctgcagacctgtatggatttgccgctgctaacata

SEQ ID NO: 283 - DNA, 1441 bp, Homo sapiens
acaatagtccagcttttattagtcaaatcacccaagccgtctctcaggctctcggtattcagtggaaccttcataccccttaccgtcttcaatcttcaggaaaggtagaatggactaatgatcttttaaagacacacctcaccaagctcagcctccaacttaaagaggactggacagtacttttacttcttgcccttctcagaattagcgcctgtccttgagatgctacagggtacagcccttttgaacttttatatggatgtgctttcttgcttggccccaaccttgttccagacaccagccctctgggcaactatcttccagtcctccagcaggctagacagaaaattcaccaggctgctaatcttctcacaaccttccgtagcttctctaataacttctctgctagcatcgcagacatatcacaaactttattaatccttcaggcccaggttgactctttagctgcggttgtcctccaaaaccgccaaggccttgacttactcactgctaaaaaaggaggactctgtatatttttaaatgaagagtgttgtttttacctaaatcaatctggcctagtatatgacaacataaaaaaactcaaggatagagcccaaaaacttgccatccaagtaaataattatgctgaacccccttgggcactctctaattggatgtcctgggtcctcccaattcttagccctttaatacctgtttttctccttctcttatttgtaccttgtgtcttctgtttagtttctcaattcatacaaaaccacacccaggccatcaccaatcattctatacaacaaatgctccttccaacaaccccacaatatcaccccttaccccaaaatctttcttcagtttaatctctcccactctaattacccatgccaccacaatcctgctcaaagcagccctgagaaacatcgcccattatctctccataccacagccaaaattttttgctgccccaacacttctccactattttgttttgtttttccactattttgttttgttttgttttgttttgtcaggcctctgagcccaggctaagccatcatatcccctgtgacctgcaggtatacatctagatggcctgaagcaactgacgaaccacaaaagaagtgaaaataggcagttcctgccttaactgatgactttccaccattgtgatttgttcctgccccgccccaaccaatcaatcgaccttgtgacattcctcccctggacaatgagtctcatgatctcccctctgagcaccttgtgacccctgcacctgcctgcaagagaaaaccccctttaactgtaattttccactgcctacccaaatcctataaaactgccccaccccatctccctttgctgactcctttttcggactcagtctgcctcgcctgcacccaggtgattaaaaagctttattgctcacaca

SEQ ID NO: 284 - DNA, 1251 bp, Homo sapiens
ttacagtagagagtcaggcagacatgagcagggcaggagagtgccctcctctgccaaccaggactctcagatgaccatcaggtaatgctcaagcagttattaaactgtctctctaaaataataattggttgcagccagtaccagagaaaggcagtctcccaatagatagaaaaacctgaaactggtgatcagcttcctgataagatctcaggagttgggtaactgggttcaagcatgtgcactaagaggcaaaatggtaaagtttaactgctatatgaccttacaggaacactcgactggtaagggaagaacacaagcatgcaaacacctccagtaaacacaccacacatgcagcccctcccaagtgctgccaggccactgtgcatgtggaatgccaatgtataagaccccaagtcaaaggtcaaaccatgtacttgatctctaaagttgcccccttggccttcttccaagtgtactttacttccttttgatagaggcagacaatgcctagacagataggggtgggtcccccactaaaccccacttccaagctgaagagagttgaaagcctgaaagccaagctgcaagttaaatcctcagaccagattgagaacttgtcttcccatttggtgcactttcctctaattggtccccacccttcacttattttacatataccgaccctttcctaattggtttttctacactgtcatgcccacctttgagtggtgtcttcactttaaccttttttgcataattacaaaccaatcagcatgcactccccatcctgagtccataaagagtctcagacccagaaacaccggggaaccatccttccccctaccctaccctcccctctccaatgaaagctgttttcatcactcaataaaattcttctctgccctcctcaccctccaatgtcctgcatatcctcattcttcttgggcacagtacaagagcttgggaatcaccaaacgcaggtacaagctgtaacacaggcaagctgaggcacacagcatggccgagcaaggcccaggtggggcattgctggccaggagtccccagcttgcaaagtgaccaagaagaaaaatcctgcatcactttcgttcctactctaaagctttttaattaactttcactcctgctctaaaacttgcctcagtctctcactctgccttattataccttcagtggaattctttcttctgaggaggcaagaatggcagttgctgtagacctgtacagatttac

SEQ ID NO: 285 - DNA, 958 bp, Homo sapiens
gtggggaaaagaaagagagatcagattgttactgggtctgtgtagaaagaagtagacataggagactccattttgttctgtactaagagaaattcttctgccttcagatgctgttaatctgtaaccttacccccaaccctgtgctccctgaaacatgtgctgtgtccactcagggttaaatggattaagggctgtgcaaggtgtgctttgttaaacagatgcttgaaggcagcatgcttgttaagagtcatcaccactccctaatctcaggtacccagggacacaaaacactgcggaaggccgcagggacctctgcctaggaaagccaggtattgtccaaggtttctccccatgtgatagtctgaaatatggccttgtgggaagggaaagacctgaccgtcccccagcccgacacccataaagggtctgtgctgaggcggattagtaaaagaggaaggaacgcttctttgcagttgagacaagaggaaggcatctgtccctgggcgatggaatgtctcagtataaaacccgattgtatgttccatctactgagatagggaaaaaccgccttagggctggaggtgggacaggcgggcagcaatactgctcttcaaggcattgagatgtttatgtgtatgcatatctaaagcacagcacttaattctttaccttgtctatgatgcagagaactttgttcacgtgtttacctgctgaccttctctccgctattatcctatgaccctgccacatccccctctctgagaaacacccaagaatgatgaataaatactaagggaactcagaggccggcggggatcctctgtctgctgaacgccggtcccctgggcccccttttctctttctctatactttgtctctgtgtctctttcttttccaagtctctcgttccacctaacgagaaacacccacaggtgtggaggggcaacccaccccttca

SEQ ID NO: 286 - DNA, 414 bp, Homo sapiens
gtcaggcctctgagcccaagctaagccatcacatcccctgtaacctgcacgtacacatccagatgatcggttcctgccttaactgatgacattccaccacaaaagaagtgaaaatggcctgttcctgacttaactgatgacattgtcttgtgaaattccttctcctggctcatcctggctcaaaagctcccccactgagcaccttgtgatccccactctgcccgccagagaacaaaccccacccttgactgtaattttcctttacctacccaaatcctataaaatggccccacccctatctcccttcgctgactctcttttcggactcagcccacctgcactcaggtgaaataaacagccatgttgctcacacaaagcctgtttggtggtctcttcacacggacgcacatgaaa

SEQ ID NO: 287 - DNA, 575 bp, Homo sapiens
taattgatcacagccagtgccagagaaaggcagtctcccaatagatagaaaaagcctgaaactgaggatcagcaacttcccaataaaatctcaggagttggatgagtagtctgaagcacatgcattaagaggcaaaatggcagagtaactggtatgtgtccttcctctagaaacactcaactggtaagggaaggcccaagtggtgtacaatctcagtaaacacactgcgatgcggcccctcccaagtgctgacaggccgctgcacatgcagacagcctaccccaagggaagaatcagaggagaagtaacacaggaccctggaagcatgccagtgtataaaaccccaagtcaaaaggtcaaaccatgcacttcatctctctagtcacctgcttggtcctcttcaaagtgtactttctttcattcctgttctaaagcttttaaataaatttttcactcctgctgtaaaacttgccttggtttctcattctgcctaagccccttggtcaaattctctcttctgaggaggcaggaattgaggttgctggcttcactactggtaacataatttggtacca

SEQ ID NO: 288 - DNA, 2855 bp, Homo sapiens
tagagaaaaaattttggagcccagccaatacctcctctggagggcagaatatgatgagttatgcgaaaaacaagccaaccataatctagtggccggacaagacataacagctgctatgctccaggggaggggtccccatgctgatgtacaacaacaactaaattttgatccccaggtctatgcacaagtgtctttgtgcgctctcagggcttggaactgaattcctgaaagtgaagttcaatggggatcttttataaatgttcaacaagggcctcagaagccatttgttgaatttatcaatcagttaacccaggcaattaagagacaaattagtcatgcctagtgcctaggctgctgatatcttattgctgcaattggcttatgaaaatgctaacgtcaactgccagcaagcaatgcagacaatcagaggaaaggcagccacagttggagaacttacacgagcatgtcaactgatggggactgaaacacacaaagccaaaatattggctatggcattaaggcctcctaaagtgaaaagaaagagaaatctaaattgttttctatgtgcagagcgaggtcatatgaagcgggaatgccccaataatagaggctaaggtaactcaggaaaaaacccccttctatatgcccccaatgtaaaaaggggaaacattgggcaaatcaatgcaagtccaaatttgataaaaatggcaatcccataagtactcaggtgggaaactgcatgaggggctgtccccaggccccattccaaactggggcaatgccagtggctttcctcggtcagagagaaagcccacagtcttctctcttggagcagccaccattgggagtgcagaactggaattactctgccaatgaattagtgctaaaagaaggagaggaccctaaaaaggttgcaaccaaggtctggggcccactgcctccgggaacagtgggatttgttgtagagtggtcaagcctatccagtaaagaaattaatgtgctcaccggggtaattgataatgactatcaaggtgagatattagttatgatggaatgtaaaggttgcatattcttccccctggatcaaagacagctcagttactactgttaccatactgggtccccagtgcccagggagaggaaaggggaaagggaagttttggaaacacaggagccataggggtatattggaatcaactaatcactgatcagagtcccatgatcaccttaaagattggaaataagaattttactggcttattggaaacacaggtggatatttcaataattaatgatcaaaactgggcagaaacttggccttgggtcactcagaaacaaaaaattgtcagcatcggggaagtgcacacaaccaagcagaagagcacacacctcctaacatgttgtgattttcaaggaagaaaggcagttatacagcctctaattatgtccatccctgttaatctccggggatgagacctgttagtcaagtgggcggcgggaggagcgggggggtcactctgcagaaccttttctaataatgtctactgttattatccctcccttacccctgatgtggctttctcaagatccaatttgggtggaacagtggcctttaaagggagagaaattacaaagagcccctgaattagttgaagagcaattaaaagccagccatatagaaccatcaaacagcccttggaattcagccattttcatcattcccaaaaagtctggtaaatggagacttttgcatgacttacgtgctatcaatgctaatttgcaacctatgggaccccttcaatagggtttcccttcccccacggtgattcctcaagaatggcctatagtcattattgacttaaaagactgcttttatactattccccttacaggacagagaaaaaattgtgtttaccatagcagctatcaataatgaaaggccagctcaccaatttcattggaaggtacttcctcaaggaatgctgaacagccctgccatgtgtcagtatcatgtaaatcaggctttgttccccagtagaaaagaatttcctaattgcaagattattcattttatggatgatattttactagcagccccaacagagccagtacttttaagtttatatgcctctgttgtaaagaatacacagttaaggggtttaatcatagcacctgaaaaagtacagatgtcctctccttggaaatatcttggatacatactaacttcccagtcagtaagacctcaaaaggttaaattcaatactagcaacttacacaccttaaatgattatcagaaattgctgggtgatatgaattgacttcgccctaccttgggcataactactgataagttacaaaacctgttttctatcctaaagggcaatatgtccctggattctcccaggtgtttaactcctgcagcaaaaagggaacttgatgaaatagagcaagctatttctagaggcagctagatctcatagatccatgacattcagttcagttgtttgtttttcccactaaacattccccaacaggattaataggacagaaggccccagggctgtgctttctagaatgtactttttgctcacatacggggactaaaactctgtctccctatatccagctagttagtaaagtcatctattgaggccacagatgatgcaatctattgctaggttatgaccctgatgttattagaattcctttgagtaaaaagcgatttgaagcagtattgcccttatgtctaaacctgcaaatagcactctcttattacacaggccatatagaacatgcccttcctgccaacaaactccttcagttctcatctcgtaatcctgtggttttgcttggaa

SEQ ID NO: 289 - DNA, 961 bp, Homo sapiens
gtggagaaaagagagatcagactgttactgtgtctatgtagaaagaagtagacataagagactccattttgttctgtactaagaaaaattcttctgccttgagatgctgttaatctgtaaccctacccccaaccctgtgctcccagaaacatgctgtgttgactcaaggtttaatggatttagggctatgcaggatgtgctttgttaaacaaatgcttgaaggcagtatgcttgttaaaagtcatcaccactccctaatctcaagtacccagggacacaaaacactgcggaaggccgcagggacctctgcctaggaaagccaggtattgtccaagttttctccccatgtgatagtctgaaatatggcctcgcgggaagggaaagacctgactgtcccccagcccaacacccgtaaagggtctgtgctgagaaggattagtaaaagaggaaggcctctttgcagttgagataagagaaaggcacctgtctcctgctcgtccctgggcaatagaatgtctcagtgtaaaaccggattgtatgttccatctactgagataggagaaaactgccttaaggctggaggtgagacatgctggcggtaatactgctctttaatgcaccagatatgtttctgtatgtgcacatcaaggcacagcaccttttctaactttgtttatgacacagagacatttgttcacatgttttcctgctgaacctctccccactattaccctattgtcctgccacatccccctttccgagatggtagagataatgatcaataaatactaagggaactcagagactggtgccggcatggtcctccgtatgctgagcgacgatcccctgggcccacttttctttctctatactttgtctctgtgtctctttcttttcttagtctctcatcccacccgacaagaaaacacccacaggtttggaggggcagggcaccccttca

SEQ ID NO: 290 - DNA, 668 bp, Homo sapiens
ttacagtaggtagtaacaaggcttgagcggggcaggagggagctctccctgctctccaccaggaatgtcgggccaccatcaggtgatgggcaggtggttgttaactgcctctctaaaataataactggtcacagccagcgccaggaaaaggcagtctcccaatagatagaaaaaaaacctgaaactggtgatgcaatcagcaggagttcagggagtggactcaagcatgagctttaagaagcaaaatggcagagtttacttgttatatgaccttctaggttcattcgatttgtaagggaagaatgcctcacctgagcacgcatacaagtccagtaaacacactgcacttgctcacctcccaagtgccagcagcccactgcacatgcagacagcccaccccaaggcaagaatcaggggagaagagatgcaagaccctagaaatatgccaaccccaagtcagaaggtcaaatagggcacttgatctctcaagtcacccgcttggccttcttccaagtgtattttatttcctttcattccttcgctaaagcttttatgataaacttttactcatgctctattgcctccatctctcctgcgttctgcctccttggttgaattctttctttggaggaggcaagaactgaggttgctgcagacccatacggatt

SEQ ID NO: 291 - DNA, 312 bp, Homo sapiens
tgggtcaggcacaaagtaagcccaccccactaggaactatgttgaaaaatttcaagaaaggatttaagggagattacagtggtactatgacaccaggaaaacttagaactttgtgtgacatagactggccagcattagaggtgggttggccatcagaaggaagcctggacaggtcccttgttacaaaggtatggcacaaggtaacctgtaagccagggcccccagaccagttcccgtacatagacacttggttacaactggttttagaccctcccgccccacacagtggttgagagaacagcagcataagtg

SEQ ID NO: 292 - DNA, 6351 bp, Homo sapiens
gtcaggcctctgagcccaagccaaatgaaatttggtgccatgactcggctcgggggacctcccttgggagatcaatcccctgtcctcctgttctttgctccgtgagaatgacccacctgtgacctcaggtcctcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacacgttttatccatggacccaactccggcaccggtcatggactgggaaggcagccttcccttggtgtttaatcattgcagggacacctctctgattatacactcacgtttcaagggtgtcagaccacacagggacacctgccttggtccttcacccttagcggcaagtcccgattttctgaggaagggacaagtacccctcaaccccttctctccttgtctctaccccttctctgcttttctggggcaggggcaagaacccctcaaccctttctccttcacccttagcggcaagtcccgctttcctggggcaggggcaagtacccctcaaccccttctccttcacccttagtggcaagtcctgctttcctagggggcaagaaccccccaatcgcttatttccataccctaacctcttatctctgtgccccaatcccttatttctgcaccctgacctcttatctctgtgccccaatcccttatttctgtgccccaacaccttctctgcttttctggagggcaagaaccctccaccccttctccgtgtctctactcttttctctgggcttgcctccttcactatgggtaagcttccaccttccattcctccttcttctcccttagcctgtgttctcaaaaacttaaaatctcttcaactcacacctgacctaaaacctaaatgccttttcttctgcaatgccacttgaccccaatacaaactcgacagtagttccaaatagccagaaaatggcactttgaattttttcatcctgcaaaatctaaataattcttgtcgtaaaataggcaaatggtctgaggtgcctgatgtccaggcattcttttacacatcaatcccttcctagtctctgtgcccagtgcaactcgtcccaaatcttccttctttctctcccacctatcccctcagtaccaaccccaagcatcactgattctttctaatcttccttttctacagacccatctgacctctctcttcctccccaggctgctcctcaccaggccgagctaggtcccaattcttcctcagcctccgctcctccaccctataatctttttatcacctcccctgtaggggtgggttgcccctccacacctgtgggtgtttctcataaggtggaacaagagacttaggaaagaaaaagacacaaagtatagagaaagaaataaggggacccggggaaccagcgttcagcatatggaggatccccccagcctctgagttcccttagtatttattcatcattcgtgggtgtttctccaagagggggatgtgtcagggtcacaagacaattgtggggagagggtcagccgacaaacacgtgaacaaaggtctttgcatcatagacaaggtaaaggattaagtgctgtgcttttagatatgcatacacataaacatctcaatgctttacaaagcagtattgctgcccgcatgtcccacctccagccctaaggtggtttttccctatctcagtagatggaacatacaatcgggttttataccgagacattccattgcccagggacgggcaggagacagatgccttcctcttgtctcaactgcaagaggcatgccttcctcttatactaatcctcctcagcacagaccctttacgggtgtcggggtgtcgggcggggggacagtcaggtctttcccttcccatgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtttgacacagcacatgtttcagagagcacggggttgggggtaaggtcacagaatctcaaggcagaagaatttttcttagtacataacaaaatggagtctcccatgtctatttctttctacacagacacagtgacaatctgatctctcttgcttttccccacatcccctcctcacacctggtccggcttacagtttcgttctgtcccccacctgcccagcaatttactcttaaaaaggtggctggagccaaaggcatagtcaaggttaatgctcctttttctttatcccaaatcggatagcgtttaggctctttttcatcaaatataaaaacccagcccagttcatgacttgtttggcagcaaccctgagacactttacagccctagaccctaaaaagtcaaaaggccgtcttattctcaaaatattttattacccaatctgctcccgacattaaataaaactccaaaaattaaattccggccctcaaaccccacaacaggatttaattaacctcgccttgaaggtgtacaataatagaaaaaaattgcaattccttgcctccactgtgagacaaaccccagccacatctccagcacacaagaacttccaaacacctgaaccacagtggccaggcgttcctccagaacctcctcccacaggagcttgctacacgtgccggaaatctggccactgggccaaggaatgcccgctgcccaggattcctcctaagctgcgtcccatctgtgtgggaccccactgaaaatcggactgttcgactcacctggcagccactcccagagcccctggaactctggcccaaggctctctgactgactccttcccagatcttctcagcttagcggctgaagactgacactgcccgaacgcctcggaagccccctagaccatcacggatgctgagcttccggtaactttcacagtggaaggtaaacccatccccttcttaatcaatacagaggctacccactccacattaccttcttttcaagggcctgtttcccttgcctccataactgttgcgggtattgatggccaggcttctaaacctcttaaaactccccaactctggtgccaacttagacaatactcttttaagtactcctttttagttatccccacctgcccagttcccttattaggctgagacactttaactaaattatctgcttccctgcctattcctggactacaactatatctcattgctgcccttcttcccaatccaaagcctcctttgcatcctcctcttgtatccccccaccttaactcacaaatataagatacctctactccctccttggtgaccgatcatgtaccccttaccatctcattaaaacctaatcacccttaccccactcaatgacaatatcccatcccgcagcaggctttaaaaagattaaagcctgttatcactcgcctgctacagcatggccttttaaagcctataaactcttcttacaattcccccattttacctgtcctaaaaccagataagacttacaatttagttcaggatctgcgccttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcatttctcataaaaacccacatgctctccctgccaatcgtgtccaactgatctctcaaacccaagcaccttctacaaaacaacaactactttccttcctaggtatggttagcatggtcagaattcttacacaagagccaggaccacaacttgtagcctttctgtccaaacaacttgaccttactgttttagcctagccctcatgtctgcgtgcagcagctgctgctgctttaatacttttagaggccctcaaaatcacaaactgtgctcaactctctctctacagttctcataacttccaaaatctattttcttcctcatacctgatgtatatactttctgcttcccggctccttcagctttactcactctttgttgcatctcccacaattaccattgttcctggcccagacttcaatccagcctcccacattattcctggtaccacacctgacccccatgactgtatctctctgatccacctgacattcacatttccccaaacttccttctttcctgttcctcaccctgatcacacttgatttattgatggcggttacaccaggcctaatcgccacacaccagcaaaggcaggtgatgctatagtacaagccactagcttgcctcttagaacctctcatttccttcccattgtggaaatctatcctcaaggaaataacttctcagtgttccatctgctattctactactcctcagggattattcaggccccctcccttccctacacatcaagctcgaggatttgccccacccaggactggcaaattagctttactcaacatgacctgagtcaggtaactaaaacacctcttagtctaggtagacactttcactggataggtacaggcctttcctacagggtctgagaaggccaccacagtcatttcttccattctgttagatataattcctcagtttagccttcccgcctctatacagtctgataacagatgagcctttattagtcaaatcagccaagcagtttttcaggctcttagtattcagtgaaacctttatatcccttatggtcctccatcttcaagaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccaacttagactgtgcccccgaaaaacttgtcatccctactatcttctgtctagtcatactcctattcacctttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctccttaggcattctctaatcagatatcctgagtcatcccaattcttagaccttttatacctgtttttctccttctgttattccatttagtttctcaattcatccaaaaccatatccaggccatcaccaatcattctatacgacaaatgtttcttctaacaaccccacaatatcaccccttaccacaagacctcccttcagcttaatctctcccactctaggttcccacgccgccccaatcccgcttgaagcagccctgagaaacatcgcccattctctctccatatcaccccccaaaaattttcaccgccccaacacttcaacaccattttgttttatttttcttattaatataagaaggcaggaatgtcaggcctctgagcccaagccaagccatcgcatcccctgtgacttgcatgtatatgcccagatggcctgaagtaactgaaaaatcacaaaagaagtgaatatgccctgccccaccttaactgatgacattccaccacaaaagaagtgtaaatggcctgtccttgctttaagtgatgacattaccttgtgaaagtcattttcctggctcatcctggctcaaaaagcacccccactgagcaccttgcgacccccactcttgcccgccagagaacaaaccccctttgactggaattttcctttatctacccaaatcctataaaacggccccacccttatctcccttcactgactctcttttcagactcagcccacctgcacccaggtgaaataaacagccatgttgctcacacaaagcctgtttggtggtctcttcacacggatgtgcatgaaa

SEQ ID NO: 293 - DNA, 8235 bp, Homo sapiens
aatgggaatctaagaaaagaggtaatcattttgaggctggaatgcttcgagtaagagtcactataaggtgatggagacagggatataggctggcccaaggttgccggcagaagaaactcataggacagagatgaaggtcggtcccaggctgaaagattatcattagaacagagatgaaggcaaggttaggggtatatggtaagaccagtttattcagaacctgaaggaagaacaggacagggcccactgttcactttggtatctcttctcaagtgggtagttgtgatgagatgggaccaaggataagggaacatggtaagacaggttcattccagaacccaagtcacaaatggggacaccttattaaagataatatgaaactaagaggggatgccttctttttcctttttctttctttttttctcctctgttctgtcttcacagatgggtaattatggctccataccacaggacacaaccctcgcatgcatcctcaattgaggatgcatgcgaggggtgtgtcctaaaaagtaaatgactagtgtttttctgtaacacagcctgtgttgaatacaagcttgaatacaagctttgggaccaggaattttggctggaaaatggaagcctaaattttaatatgatctatcaactagatttgttttactaccagaaagaaaaatggacagaacccctatgtacaggccttcatggcccgaaaaaacaaccctgccctttgtcaggcttataaaattgatccagcaatggtagtggccatcattaggcagccgcctgcaattggttcaggacatccattattgagtttactcagggctgaagcaccagaggaaccaagagcagagtttagctcaaaccccactgtcctttctaccctgttatatccaaatctcccagccccagaaacttcccctccctacccagggtcatcctctggaaatcacccccttaagttacgccctcttcaagaggttagtggccccagtagacccactagagtccagactccattcactatgcaagacctgagccaaattaaaacagaactagggaagtttataaaggaccctgacaaatatatcaaagggttccataaactgggcttaacatttgaactcacctagaaggatttatcagtcatatagagaaaactccgtctaagaatatgactccattatggagggggccaacaatttgcaaattcaatgcatataatggttcctggtggctaccctgtgggatccactgcagttccccaggtcaaccccaattggtattacaatacccaggggggtatatgggcaaaggaccacatgttcatctgtctggtagaagagtaaaagctagaataacaaagcctgtgacctctaatagattggccttaatagaccaagcccatcttgaaaacccattgctgtcctagagaggctacaagagaccctaatgaaacataccaacattgactcagagacaccagaaaggcaactggtcctaaaggaccatttcctaactcaggcagccctagatattcagaggaaactccaaaagctcacactgggccctgatatccctatgcttgacatcctcagactaacttccttggtcttttacaaccaggacctggtgaaagaggaaagggctcaggaaaaggagaggcaaaaggaaaagcagcagttccaactacttgctgccctacaagtctgctaagccccttgaggttgctcttggaatatcttcccaggcaactgctgtcagtgtgggaagccaggccactggaaggccaattgccccaatgagatagatgggaaaaagccctgaacagcttggctcctctgccacaagctcgtcccctgaaaacaggactgccctgagctctgaaggaaccctgggacagaatcctaatccctgatagccttgagctgaagaggccctatgctctggttggctcctggatcaaacttcactatagaagagatggagccaagggctgctttggatgtggtaggtagaaatataagttttcttttggacacaggagcagcctgctcagtgcttatctcttttactgggcaattattctccaaattccctcagctgatggtagtaaatggggcactcataacctggaggtttactcctcttctgtggggcctgtgtgtggcaactgttttttctcactcatttttagtgatgccagaatgtcctatgtcccttttgggtagagatattttgttcagactaggatctcagttaacctttcctccaggaccagcacacccttttccaaatacaatcttaggccacacacacacacacacacacacacacacacacacacacacatgtatgaactgtgcacaggccttcccattaatccagaggtctgccccccaggaataccaggaaaggccataatggcaatgcctatagtaattcagctcaagaatcttcctgctatcctgtagaaggctgtttcctcttcagccagaggaggaaaagggacttccacccatgattgaaaaatctgtaaaacatggattattaataccctgtaactcaccctgtaacacccctatcttacctgttaaaaagagcaatggaacaatggagaatacaggctagtccaggacctgcaaatcttgaatgaggcagcagtctcaatacacccaatggtccccaatgcatatgtaattccaggagaagtacctccagaggctcagtggttttcagtcttagatctcaaagatgctttcttttgtatccccttagacccatcatcccgacttttattgcatttgagtgagagaattaaaaaggaaagattcaactggacagtgcttccacgaggttacagagatagtccccatttgtttgggcaagtcatggctagagatttgcaggttctaactcttaaggggagagggtgtcttctatagtatgcagatgatctgttagtctgttctcccacaagaacattaggaatccaacatctagtccagactttaagttttcttgcagacagaaggtacaaggtgtccaaagccaaggaacagctactaacacaagaggtctaatacctgggaatgatccttacccctggagaacataagctctctccggaacagataaagttcatccttagaatacctaccccaaccacttgaaagcaatttcgggcttttctagggatcacaggatattgcagactttggacactgggatatcgtggaattgttaagttcttatatcaggctccaaaagaagggactgatagggacccacttcagtgagaaaaggatcaagagcaagcctttaggcagctaaacactgctctctcacaagatcctgcccttgggccacccatactaaccaaatcttttcatcactaagaagcaaggtgtagccctaggagttctaactcaaagtgtctggccaatcaatcatcctgtaggctacttttcaaagaatctagacccagtagcataagcgtggctacattttctcaaggtagtggctgtagcagccctctcacttgagaaggccctcaaaatcatgatgggacagtcaatctggctcctgatgttccacaaaataggcccttcattggacataaaggaaccacagtggctcactgacaacagactgatcaagtactaagtcttgttgttagaaaacttgagcagtctgttgagtggcgttctacccttaacccaacctccttactcccactaccaggaaaggatgactcaaaacatgcgcattgtgagatgcttaaccaaatttatgccagtctgtaagacttaaaggatcagcccctagataatccagatagaatatggttgtcatattgcagtagctttgataggaatgaaatcagataggaagggtatgctatagtgtcccttcaccaagttatagaggctaaagttctgtccctgggaacctcagcacaactagccagactgatttttctgaccagagcactaaaactagggcaaaaaaagaagaatagccatgtgtgtggattccaaatacgcctttctggtgcttcctgtgcacatggttatctggaaggaaagtgggtatctaacaccttgggatattcctattaagtaagggcctcaaatattagagctagtagaggctgttcagttgccccaggaagtgacagtagtgcactataaaggagaccagaagaactctgatgaaagtgcatgggaaataggttagctgaccaaaaagctaaagacacagccatttcaaacgataccttcatggaggccttattcccctctctccccagtgaacttccccatctccaatacactaaggaagaagtagattgggccactttacatgggtataaagaagaaactaacaaattgtacaggttgggagaacttctccatctacttaaagcctcccaatggaaagtcatcaagagtttacctgactcctggcaccttggaaaggacagtctaaggcaaatttgtaaatgagtgttcagtggaagggactaaatctaaacaaaactattcaacaggttttttaagcctgcaccttgtataccataaataatccccagagatggaatcccctttcattagtaagttcaatccgaagtagaggtacataccctggggaggagtggcagatggactccattcagctccccacattctgcaggtaaaaataccttttggtctgtgtagatgtcttcacaggatgtgtagaagcctgcttcacaaggacagaaaaggcatgggaattagctaaattcctcttaaaggaactcattccctgatttgggctccctgggtcattgcagaatgacaatggtccatcctttatttcccatgtaactcaacaggttagtagttccctaggtataaagtagtaccttcacactgcctggagactgcaatcttcaggaaaagtggagagaactaaccaaaccctcaaacgcatccttaataaactctgccaggaaacagcatagccatgagtgtggacctttcacctttagctctcctttgcatctgtattgcccctaacactcccttggaataaaggcctttagaggccttatatggtagaccattcctatattaagacttattaccagatgaagaaactgccaaaatcacctagtatgtctcttctttagcagggttccaacaggctctccaggaatatggaggaaacctaaaatcagaaggggaaaaatccccacctctgcatcctctaagctcaccagttctgattaaagcctgaaagaatgcaaccctgaattcccaactaactccactctggaagggccccttcactattctattatctcctcccatagccattacagtaccggagattgcctgctggatatatcatacccaagggaagctgtggaaaggaccccacacaccagagccagaagaaacacccacagctcctgaatatacttgcaaggcactggaagatctgaaattcctctttaagtgaaaagataagtaatgcttattcacctcaaagtaaggtgatcccaatgtcaggaattttacttgcaattgctctgattgttatcattattttaaccctaacctgtacaccaccagaagtttcagcagcagcttgctttgtgaacaatttctctcttttacaatcaccataggtcgctgtggtctgctcctgctggttctcatactcaccactttatgagtagcatgctatcatcttgatttcccatgagaaaatactcggcaattgatccaaagcacgggattcccttccccaccaattgcttctactaaaacaccagagagagcttttccagcctcgcccagagactggacaagcatacaggtggaattacgtagtttctatcaatgagacctaatctgaaaaggatgtttggacctgcaaatagtcttcttgcaaaagtaaagcaagatttcattggtatctgcagggagcctcccatttttgggcccatcttttctaacatcgatttaatggcagtagcctctatttgtgttataaccaaaagcaaaaatgtaaagaatgtaggcactcttccatgtacatgttctaacagtacagtttgtagtgttactttcactgtagagcctaaccaacagacataccaagcatatacccatagccaattctaccatcaaccaagattctccaaacctccagatattacctttccttggggatctttgctagataagtccacccagttttgtcagggatgcccaatctcatgcagtactcaaaatttctggttccagcctgttgtttataaccaatatctgcaaattgtcaatctcagctccacagcagaatggatcctattagacgaaactcaaaattcttttttttgggaaaataaaatcaagggatctaaacaaagccaaacctcatgcatcaaagtattagcaggcaaaactgtagccaccaactacctgggtgtgtcagcagtcttggaattttttggaacctccctcacccccttattttgttttaacatccctacttctcttaaaacccaaggagacttctatatttgtggctaattagttcaccaacgcctccctgctagctggactggaacttgtaccataggctatgtatccctggacgtctttatgggccctggtaatctctcttttacagtaccagtctatgagcattccatcttgcccaggaaggctatccaattaatttccctctccttctcatgagactcagcattatagccaatacaagaagtggaattactggaatcacaaaaccctccttaacctatagccagctctcaaaggaaatagccaacaacactgatgccatggctaaaaccttaacaaccaagcaagaaaaaatcaactctttagcagctgaagtcctccaaaattgtcgaagactagataccctaacagcagcacagggaggaatttttttagccttacatgaaaaatattgcttttgagtaaatcaattgggaaaagtagaagacaacatcagacaactcctaaatcaagcctccagtttatgggaacaagcctcttgagttggctaaattgggaaggaacctggaaatggttctcctgagttcttccatttttaggaccacttgttggtctacttttgctcttttttggttcatgtcctctaaatctaataatccagtttggccccttttaccttcaggccatcaagctccagataatcttcagtgaaggatacatgctttcaatattcaagaaccatccttctgcagaggacccctagagtgcccatcagtgggacacgacagaagtggcattctgcccctgtatcccttggacctagctagatactgctttcaccagcccatggagctaccctgccctgagagctagcaagaggctaagacctactgaacaaccaccaccacccctctgtcagcaggaagcagttacagaagactgacatgtgttcattttcccaaaataattggggtcttagactcctgcgggggggaatgttacagaaggtagctagtcagacatgagcagagtaggagagaccccaccaccaccagaaatgtcaagcaaccatcaagtaatgatcacatggtattaaactgtctctctaaaataaaaactggtcgcagccagcagcaccagggaaaggcagtcttccaacggataaaaagacctgaaactcttgatcagcagcttctcgataagatctcaagagttgggtgagtcagctcaattcaagcttgtgcattaacatgaaaaatggtgaacttttactggtatataaccttccagggacatttgattagtaagggaagaatgcctcaagtgagcatgcttacaactcctgtgaacacactgcacacgcagcccctccctagtgctagaaggccactgtacatccagacagcctatcccaagggaagaatcaggaagagacacaagactccaaaagtatgccaatttagaaaaccttaagtcaagggctaaactaggcacttgatctctcaagttgcccacttggcctcttccaagtgtagtttacttccttctgttcctgctctaaacttgttaataaatttttactcctgctctaagatttgcatcgatctcgcattgtgccttatgcccctcggccgaactctttcttctaaggaggcaagaactgaggctgctgcagacctgtacagattcacca

SEQ ID NO: 294 - DNA, 8111 bp, Homo sapiens
gagagacaggactagctggatttcctaggccgactaagaatccctaagcctagctgggaaggtgaccgcatccacctttaaacacggggcttgcaacttaactcacacccaaccaatcagagagctcactaaaatgctaattaggcaaaaacaggaggtaaagaaatagccaatcatctattgcctgagagcacagcaggagggacaaggatcgggatataaacccaggcattcgagccggcaacagcaaccccctttgggtcccctccttcctatgggagctttgttttcactctatttcactctattaaatcttgcactgcactcttctcgtccatgtttgttacggctcgagctgagcttttcgctcgccgtccaccactgctgtttgccactgtcgtagacccgcccctgactcccatcccgccactgactcccatccctccagatccggcagggtgtccgctgtgctcctgatccagcaagactccggttgccactcctgattttgctaaaggcttgccattgttcctgcacggctaagtgcctgggttcgtcctaattgagctgaacactagtcactgggttccacggttctcttccatgacccacagcttctaatagagctataacactcactgcatgatccaagattccattccttggaatccgtgaggccaagaatcccgggtcagagaacacaaagcttgccaccatcttggaagcggcccaccaccatcttggaagcggcttgccaccatcttgggaactctgtgagcaagggcctcaggtaacattttggtgaccacgaagtgacctccaaagcggtgagtaatattggaccactttcgcttgctattctgtcctatccttccttggaattggaggaaaataccgggcacctgtcgaccagttaaaaacgattagcatggccgccggacttaagactcaggtgtgagactatctggcgaagggctttctaacaacccccaacccttctggcttggggacgttggtctggtcggagcagcttccactttcaattttcatggggaagccgagggccgactagaggcagaaagctgtcatcccgaactcctggcagtagccggttgagatcatggcgcagccagaattctctactcagtagatgcccatccgtgcgcccctacctttcccttctgatccatacctcctgggtcccgaccatgactttcttgaaagcatagcccccaaattctccttacctctgaatctacttcctctgatccttgcgtcctaggtactaatggttcagactttcatttcctctagcaagttgtatctccaaagggatctcaggaagctctatgctgtgtccttaggcatctaggctgtaacccagggagtcttatccctggtgtccctcccgatttaggtatacagctctcgacatgggcagttatgtgggacccattccccaccacccttgccaggggcccaagtctgtaatggctaagagagagatggagagagagagacagatggagagagagagagagagagacagagagagatggagagagagagacagagagagagagagagacagagagagagacaaagacggagtcaaagagaaagaaagaaaaagatagaaatagtaaaaagaaaagtgtgccctattcctttaaaagccagggtaaatttaaaacctgtaattgataattgaaggtcttctccatgatcctataacactccaatgccactttgttgtcagtgtaaataagggcgtagcccgaaagcactgaggccactgacaacccatagctttcctatcaaaaatccttaacccagtaacccacggatggccaaatgcattcagtcggtagcggcaactgctttgctaaaagtagaaaagtaacttttagaggaaacctcgttgtgagcacaccttaccagttcagaattattctaagtcaaaaaaaaaaaaaaaaaaaaaaaaaaagcaaaggtagcttactaactcaaaaatcttaaagtatggggctattattttagaaaagggtaatgtaactccaaccactgataattcccttaacccagcagatttcctaacaggggatttaaatcttaattaccatacaaaggtctgaccagacctaggaggaactcccttcaggacaggatggtagatggttcctcccaggtgattaaggaaaaaaaccacaatgtgtattcagtaattgatacagagactcttgtggaagcagagctagaaaaattgcttaacaattggtctcctcaaacgtgcgagctgtttgcactcagccaagccttaaagtacttacagaatcaaaacactacctcaatcctgactccaaagattcgctacatcctctctggaatgaatttgcataagaactattgtttatggggatgcatcttcatggggcagctgggttgttatgaaatactcgggaacccggcccagctctaggactcactcctgagcacaaaggcaatgttgggcacgctggtaaaggatcactagaatcctgcagcccgaacccctctctttgtggtcaagagaggcgctaaaataggtgcagggctgctacattggtgagcataactaatctgataagcagaggtccatgggtggttacgcaccctggaaaagaataagcattaggcccttagaggacgctctaggactaatgcttatcggaaaatgactaggggtgctggcatccctatgttcttttttcagatgggaaacgttccccccaccccaaagcaaaaatgcccctaagatgtactctggagaattaggaccaatttgaccctcagatgctaagaaagaaatgacttatagtcttctgcagtactgcctggccacaataccctcttaaaagggagaaacctggccttctgagggaagtataaattataacactatcttacagctagacctcttctgtagaaaggagggcaaatggagtgaagtgccatatgtgcaaactttcttttcattaagagacaactcataattacgtaaaaaatgtggtttatgccctacaggaagccctcagagtctacctccctatcccagtgtccccccgactccttccccaactaataaggaccccccttttacccaaatggttcaaaggagatagacaaagggataaataatgaaccaaacagtgccaatattccgattatgccccctccaagcagtgggaggaggagaattcggcccagccagagtgcatgtacctttttctctctcagacttaaagcaaattaaaatagacctaggtaacttctcagataaccctgatggctatattgatgttttacaagggttaggacaatcttttgatctgacatggagagatataatgttactgctaaatcagacattaaccccaaatgagagaagtgccgccacaactgcagcccgagagtttggcaatatctggtatctcagttaggtcaatgataggatgacaacagaggaaagagaatgattctccacaggccagcaggcagttccgagtgtagcccctcactgggacacagaatcagaacatggagattggtgccgcagacatttgctaacttgcatgctagaaggactaaggaaaactaagaagactatgatttattcagtgatgtccactataacacagggaaaggaagaaaatcctactgcctttctggagagactaagggaggcatggaggaatcatacctctctgtcacctgactctattgaaggccaactaatcttaaaggataagtttatcactcagtcagctgcagacattagaaaaaaacttcaaaagtccaccttaggcccagcgcaaaatttagaaaccctattgaacttggcaacctcagttttttataatagagatcaggaggagcaggcggaatgggactaacgggataaaaaaataaaaggccaccactttagtcatggccctcaggcaagcggactttggagtctctggaaaagggaaaagctgggcaaattgaatgcctgatagggctttcttccagtgcagtctacaaggacactttaaaaaagattgtccaagtagaagtaagctgccctctagtccacgccccttatgtcaaaggaatcactggaaggcccactgccccaggggacaaaggtcatctgagttagaagccactaaccagatgatccagcagcaggactgagggtgcctggggcaagtgccagcccatgccatcaccctcacagagcccctgatatgcttgaacattgagggccaggaggttaactgtctcctggacactggcacggccttctcagtcttactctcctgtcccggacaactgtcctccagatctgtcactatcctaggggtcctaggacagccggtcactagatacttctcccacccaccaagctgtgaccgaggagctttactcttttcacatgtttttctaattacacctgaaagccccactcccttgttagggagagacattccagcaaaagcaggggccattatacacctgaacataggagaaggaacacctgtttgttgtcccctgcttgaggaaggaattaatcctaaagtctaggcaacagaaggacaatatagatgagcaaagaatgcccatcctgttcaagttaaactaaaggattctgcctcctttccctaccccctcagacccaaggcccaacaaggactccaaaagattgttaaggacctaaaagcccaaggcctagtaaaagcatgcaatagccactgcagtactccaattttaggagtacagaagcccaacagacagtagaggttagtgcaagatctcaggattatcagtgaggctgttgttcctctatacccagctgtacctagccctcatactctgctttcccaaataccagaggaagcagagtggtttatagtcctggaccttaaggatgcctttttctgcatccctgtacatcctgactctcaattcttgtttgcctttgaagatccttcaaacccaacgtctcaactcacctggactgttttactcaagggttcaaggatagcccccatctatttgaccaggcattagcccaagacttgagccaattctcatatatggacactcttgtccttcggtatggggatgatttaattttagccacccattcagaaaccttgtgccatcaagccacccaagcgctcttaaatttccttgctacctgtggctacaaggtttccaaactaaaggctcagctctgctcacagcaggttaaatacttagggctaaaattatccaaaggcaccagggccctcagtgaggaacgtatccagcctaaactggcttatccttatcccaaaaccataaagcaactaagagggttccttggcataacaggcttctgccgaatatggattcccaggtacagcaaaatagccaggccattatatacactaattaaggaaactcagaaagccaatacccatttagtaagatggacacctgaagcagaagcagctttccaggccctaaaataggccctaacccaagccccagtgttaagcttgccaacggggcaagacttttctttatatgtcacagaagaaacaggaatagctttaagagtccttacacaggtccgagggatgagcttgcaacccgtggcatatctgagtaaggaaaatgatgtagtggcaaagggttggcctcattgtttatgggtagtggcagcagtagcagtcttagtatctgcagcagttaaaataatacaggagatcttactgtgtggacatctcatgatgtgaacagcatacacagtgctaaaggagacttgtggctgtcagacaaccatttacttaaatatcaggctcttacttgaagggccagtgctgcaactgcgcacttgtgcaactcttaacccagccacatttcttccagacaatgaagaaaagatagaacataactgtcaacaagtaattactcaaaccaactccactcgaggggaccttttagaggttcccttgactgatcctgacctcaacttgtatactgatggaagttcctttgtagaaaaaggactttgaaaagcggggtatgcagtggtcagtgataatggaatacttgaaaataatcccctcactccaggaactagtgctcagctggcagaactaatagccctcactcgggcactagaattaggagaagggaaaagggtaaatatatatacagactctaagtatgcttacctagtcctccaggcctatgcagcaatatggagagaaagagaattcctaacttctgagggaacacctatcaaacatcaggaagccattaggagattattattggctgtacagaaacctaaagaggtggcagtcttacactgccggggtcatcagaaaggaaaggaaagggaaatagaagggaactgccaagcagatattgaagccaaaagagctgcaaggaagccattaggagattattattggctgtacagaaacctaaagaggtggcagtcttacatcaggaagccattaggagattattattggctgtacagaaacctaaagaggtggcagtcttacactgccggggtcatcagaaaggaaaggaaagggaaatagaagggaactgccaagcagatattgaagccaaaagagctgcaaggcaggaccttccattagaaatgcttatagaggacccctagtatggggtaatcccctccaggaaaccaagccccagtactcagaagaaaaaatagaatgaggaacctcatgaagacatagtttcctcccctcaggatggccagccaccaaagaaggaaaaatacttatgcctgcagctaaccagtagaaattacttaaaaccctttaccaaacctttcactttggcattgatagcacccatcagatggccaaattattatttactagaccaggtctttcaaaactatcaagcggatagtcagggcctgtgaagtgtgccaaagaagtaatcccctgcactgcaggccatacatttcaatccctgtatctttaacctccttgttaagtttgactcttccagaattaaaactgtaaaactacaaattgttcttcaaatggagccccagatgcagtccatgactaagatccactgcggacccctggaccggcctgctagcccatgctccgatgttaatgacatcgaaggcacccctcctgaggaaatctcaactgcacaacccctactatgccccaattcagcaggaaacagagcagtcattggccaacttccccaacagcacttgggttttcctgttgagaggggggactgagagacaggactagttggatttcctaggccaactaagaatccctaagcctagctgggaaggtgaccgcatccacctttaaacatggggcttgcaacttaactcacacccaaccaatcagagagctcactaaaatgctaactaggcaaaaacaggaggtaaagaaatagccaatcatctattgcctgaaagcacagcgggagggacaaggatcgggatatgaacccagacattcgagccggcaacagcaaccccctttgggtcccctcccttcctatgggagctctgttttcactctatttcactctgttaaatcttgcaactgcactcttctcgtccatgtttgttacggctcgagctgagcttttcgctcgccgtccaccactgctgtttgccactgtcgcagacccgcccctgactcccatcccgccactgactcccatccctccagatctggcagggtgtccactgtgctcctgatccagcgagactcccattgccactaccgatcgtgctaaaggcttgccattgttcctgcacggctaagtgcctgggttcgtcctaattgagctgaacactagtcactgggttccacggttctcttccatgacccacagcttctaatagagctataacactcaccacatgatccaagattccattccttggaatccgtgaggccaagaaccccaggtcagagaacacaaggcttgccaccatcttggaagcggcctgccactatcttggaagcggcttgccaccatcttgggagctctgtgagcaaggacccccggtaaca

SEQ ID NO: 295 - DNA, 412 bp, Homo sapiens
gtcaggcctctgagcccaagctaagccatcatatcccctgtgacctgcacacacacatccaaatggccggttcctaccttaactgatgacattccaccacaaaagaagtgaaaatggccagtccctgccttaactgatgacattaccttgtgaaattccctttcctggctcatcctggctcaaaagctcacccgctgagcaccttgtgacccccgccccttcccgccagagaacaactccctttgactgtaattttcctttacctacccaaatcctataaaatggccccactcctatctgccttcgcttactctcttttcggactcagcctgcctgcacccaggtgaaataaacagccttgttgctcacacaaagcctgtttggtggtctcttcacacggacgcgagtgaaa

SEQ ID NO: 296 - DNA, 489 bp, Homo sapiens
aaggaaggagaccactactactcctgctgccctcctccccccaccttgcctagttcacaaaacaggaagagagaaaaagccaaaagttggaaaaatacaaaagtaagataaatagccagacaaccttggcaccaccacccggccgtaggagttaaaaaaagtaataataataacatcaacccctgacctaaactactggtgttatctgtaaattccagacactgcatgaaaaaagcactgtaaaactttttgttctgttagctgatgcatatagccccccacagtcatgtttcccacgcttgcttgatgtatcacgaccctttcacgtggaccccttaaagttataagcctttaaaaaggccaagaatttctttttcggggagttcggctcttaagacgcgagtctgcccacgctcccagctgaataaaaacctcttccttctttaatccggtgtctgaggagttttgtctgcggctcgtcctgctaca

SEQ ID NO: 297 - DNA, 1161 bp, Homo sapiens
aaaagggcattcctaacttctgagggaacacctatcaatcatcagaaagccattaggagattattattggctgtacagaaacctaaagaggtggcagtcttacactgctggggtcatcagaagggaaaggaaagagaaatagaagggaaccaccaagcggatattgaagccaaaagagccgcaaggcaggaccctccattagaaatgcttatagaaggacctctagtatggggtaatcccctctgggaaaccaagccccagtactcagcaggagaaatagaatggggaacctcacgaggacatagtttcctcccctcaggatggctagccaccgaaggaaaaatacttttgcctgcagctaaccaatggaaattacttaaaacccttcaccaaacctttcacttaggcattgataacacccatcagatggccaaattattatttactggaccaagctttttcaaaaatatcaagcagatagtcagggcctgtgaagtgtgccaaaaacataatcccctgcactgcaggctatacatttcaatccctgtatctttaacctccttgttaagtttgtctcttccagaatcgaagctgtaaaactacaaatagttcttcaaatggagccccagatgcagtccatgactaagattcactgtggacccctggaccggcctgctagcccatgctccgatgttgatgacatcaaaggcacccctcctgaggaactctcaactgcacgacccctactatgccccaattcagcaggaagcagttagagtggtcattggccaacctccccaacagcacttgggttttcctgttgagagtggggactgagagacaggactagctggatttcctaggctgactaagaaaatccctaagcctagctgggaaggtgacggcatccacctttaaacacggggcttgcaacttagctcacacccgaccaatcagggagtaaagacagctcactaaaatgctaattaggctaaaacaggaggtaaagaaatagccaatcatctatcgcctgagagcacgagggagggacaatgatcaggatataaacccaggcattcaagccggcaatggctacccgctttgggtcccctctgtttgtatgggagctctgttttcactctattaaatcttgcaactgca

SEQ ID NO: 298 - DNA, 714 bp, Homo sapiens
ttacagtaggtagctagtcagacatgagcagggcaggagagtgccaaaccccaccaggaatgtcaggcaaccatcaagtgtggtcaggtggcgttaagctgtctctctaaaataataattggtcacagccagtgccagagaaaagcagtctcccgatagatggaaaaaaacctgaaactggtgatcagcatcttcccaataagatttcaagatttggttgagtgggctcaagcatgtacactaagaggcaaaatggtggagtttaactggtgtgcgaccttctaggaacattgaactggtaagggaagaacgcctcaagtgagcatgcgtgcaactccagtaaacacgctgcacatgcagctccttccaagggctggcaggccactgtgcatgcagagagcccaccctaagggaagaatcaggagaggagagatgcaaactctggaagcatgccaacatttaaagccccaagtcaaaggtcaaactgcgcacttgatctctcaagtcgcctgcttggctctcttccaagtgtactttactcccttttgttcctgctctaaagctttttaataaactttcactcctgctctaaaacttgccttggtctctcactctgccctgtgcccctcggttgaattctttcttgtgaggaagcaagaactgaggttgctgcagacccgtatggattcgccgctgctaacataatttggtacc

SEQ ID NO: 299 - DNA, 1149 bp, Homo sapiens
gccattgagctccagacaatcctcagtgaggaaaaccatcctctcaatattcaagagtcacccttctagagaggacctctgcacttcccatcagtgggacaagacagtggtgaaatcctgcccctgtctcccttggacttggctggataccactttcaccaactgatgcagccaactcagccctgacgggtagcaaggagccaagatccacccgaccacgaccacccctctgtcagcaggaagcagttacagaaaacagaagtcatccattttggatgacagaccttcatccaaagatttgaggtcctggactcttgaggtgagaaatgttacagcaggtagctagtcatgtatgagcagagcaagagagagaagccccactcccaacacacaccagcagtgttgggcaacaatcagctgatggtcaggcggttgttaactgttttggtaaagtaataattggtcgcagccggccccagggaaaggcagcctcttaatagatagaaaacacctgaaactgatcagcagcttcccagtaagatttcaggagtagtaataattggtcgcagccggccccagggaaaggcaggctcttaatagatagaaaacacctgaaactgatcagcagcttcccagtaagatttcaggagtagtaataattggtcacaaccggcccccgggaaaggcaggctcctactagacagaaaacacctgaaactgatcagcagcttcccaataagatttcaggagtagtaataattggtcacagccagcccccgggaaaggcaggctcctactagatagaaaacacctgaaactgatcagcagcttcccagtaagatttcaggagtagtaataattggtcacaaccggcccccgggaaaggcaggctcctactagacagaaaacacctgaaactgatcagcagcttcccaataagatttcaggagtagtaataattggtcacagccagcccccgggaaaggcaggctcctactagatagaaaacacctgaaactgatcagcagcttcccaataagatttcaggagtagtaataattggtcacaaccggcccccgggaaaggcaggctcctactagatagaaaacacctgaaactgatcagcagcttcccaataagatttcagga

SEQ ID NO: 300 - DNA, 907 bp, Homo sapiens
gtagctagtcagatatgagcagagcaggagaggacttcccccacccaaacacacacaccaggaacgtcgggtgaccatcaagtgatggtcaggcaattgttaactgtctctctaaaataataatttgtcacagccagcaccagggaaaggcagtctcccaatagataaaaaatcctgaaattggtgactggcagcttctcgataaaatctcaagagttgagtaagtgggctcaagcctgcacactatggaaatattttgcagaccctgtgcttgatggatcagctggcaccactcagactgataaatggtctcatctggtcttgtggccccccaacccaggaactgactcagtggaagaggacagctttgactccctatgatttcagctctgaaccaaccaattagcactcctgacttactggccccctacctaccaaattatttgcacactaagaggcaaaatggtggatgaccttcctctaggaacactggcctagtaaggggaaaatgcctcaagtgagcatgggtaaaactccagtaagcacactgcacatgttcccctcccaaaccctagcaggccactgcacatgcggacagcgcaccccaagggaagaatcaggggaaaagagacgcaagaccccagaagtatgccaatgtataaaaccccaagtccaaattcaaacagtacagttgatctctcaagttgcctacttggccctcttctaagtgggctttactttcattcattcctgctctaaaactttttaataaactatcactgctgctcaaaacctgcctcagtctctccttatgccttatgcccctcagttgaattttttcttctaagaaatcaaggattgaggttgctacagaaccatatggatttgcgatcagtgacatgctttg

SEQ ID NO: 301 - DNA, 5785 bp, Homo sapiens
gtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccaactcctgcgcactgagcaccttacgacccccactcctacccgccagagaacaaaccccctttgactgtaattttcctttacctacccaaatcctataaaacggccccacctttatctccctccgctgactctcttttcggactcaggcgcctgcacccaggtgaaataaacagccatgttgctcacacaaagcctgttttgtggtctcttcacacggacgcgcatgaaatttggtgccatgactcggatcgggggacctcccttgggagatcaatcccctgtcctcctgctctttgctccgtaagaaagatccacctacgacctcaggtcctcagacctaccagcccaggaaacatctcaccaatttcaaatccggtaagcggcctctttttactctcctctccaacctccctcactatccctcaacctctttctcctttcaatcttagcgccacacttcaatctctcccttctcttaatttcaattcctttcattttctggtagagacaaaagagacatgttttatccgtgaacccaaaactccggcgccggtcacagactgggaaggcagccttcccttggtgtttaatcattgcagggacgcctctctgattatacactcatgtttcaagggtgtcagaccacgcagggacacctgccttggtccttcacccttagcggcaagtcccgctttcctggggcaggggcaagtacccctcaaccccttcttcttcacccttagaggcaagtcctgctttcctagggggcaagaagcccccaatcgcttatttccgcaccccaacctcttatctctgtgccccaatcccttatttccgtaccctgacctcttatctctgtgccccaatcccttatttccatgccccaaccccttttctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttttcgtaaaataggcaaacggtctgaggtgcctgacatccaggcattcttttacacatcagtcccttcctagtctctgtgcccagtgcaactcgtcccagatcctccttctttccctcccgcctgtcccctcagtcccaaccccaagcatcgctgagtcttcccagtctttcttttctacagacccatctgacctttcccctcctccccaggctgctcgtcgccaggctgagctaagtcccaatacttcctcagcctccactcctccaccctataatccttctatcacctcccctcctcacacccggtccggcttacagtttagttccacaactagctcttccccacctgcccagcaatttactcttaaaaaggtggctagagccaaaggcataatcaaggttaatgctcctttttctttatcccaaatcagatagcgtttaggctctttttcatcaaatataaaaacccagcccagttcatggctcgttcggcagcaaccctgagacactttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtaaaataatagaaaaaagttgcaattccttgcctccactgtgagacaaaccccagccacaatctccagcacacaagaacttccaaatgcctgaaccgcagtggccaggcgttcctccagaacctcctcccacaggagcttgctacatgtgccggaaatctggccactgggccaaggaatgcccgcagcctaggattcctcctaagccatgtcccatctgtgtgggaccccactgaaaatcggactgttcaactcacctggcagccactcccagcttccctggaactctggcccaagcctctctgactgactccttcccagatcttctcggcttagcagctgaagactgacactgcctgatcgcctcgggagccccctagaccatcacggacgccgagcttcgggtaactctcacagtggagggtaagcccgtccccttcttaatcaatacggaggctactcactccacattaccctcttttcaagggcctgtttcctttgccgccataactgttgtgggtattgacggccaggcttctaaacctcttaaaactccccaactctggggccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcgtcctccaaagcctcctttgcgtcctcctcttctatcccccaaccttaacccacaagtataagatacctctactccctccttggcgactgatcatgcaccccttaccatctcattaaaacctaatcactcttaccccactcaacaccaatatcccatcccgcagcatgctttaaaaagattaaaggctgttatcactcgcctgctacagcatggccttttaaagcctataaactctccttacaattcccccattttacctgtcctaaaaccagacaagccttacaagttagttcaggatctgcgccttatcaaccaaattgttttgcctatacaccccatggtgccaaacccatatactctcctatcctcaatacctgcctctacaacccattattctgttctggatctcaaacatgctttctttactattcctttgcacccttcatcccagcctctctttgctttcacttagactgaccctgacacccattaggctcagcaaattacctgggctgtactgccacaaggcttcacagacagcccccattacttcagtcaagcccaaatttcatcctcatctgttacctatctcggcataattctcataaaaacacacgtgctttccctgccgatcctgtccgattaatctcccaaacctcaatcccttacaaaacaacaactcctttccttcctaggcatggttagtgtggtcagaattcttacacaagagccaagaccgcaccctgtagcctttctgtccaaacaacttgaccttactgttttagcctagccctcatgtctgtgtgcagcagctgccgctgctttaatacttttagaggccctaaaaatcgcaaactatgctcaactcactctctacatttctcataacttccaaaatctattttcttcctcatacctgacgcatatactttctgctccccggctacttcagctgtacccactctttgttgaggctcccacaattaccgttgttcctggcccagacttcaatccagcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcacttcctttccatcgtggaaatctatcctcaagcaaataacttctcagtgttccatctgctgttctactactcctcagggattattcaggacccctcccttccctacacatcaagctccaggatttgccccacccaggactggcaaattagctttactcaacatgccctgagtcagataactaaaatacctcttagtctaggtagatactttcactggataggtagaggcctttcctacagggtctgagaaggccaccgcagtcatttcttccattctgtcagacataattcctcagtttagccttcccacctcaatacagtctgataacagacgagcctctattagtcaaatcagccaagcagtttttcaggctcttagtattcagtgaaacctttatatccctttatggtcctccatcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaacgtcctgtatagacgctcctttttattaggccccagtctcattccagacaccagaccaacttagactgtgcctcaaaaaaaaaaaaaaacttgtcatccctactattttctgtctagtcatactcctattcaccgttctcaactactcatacatgccctgctcttgtttacactgccggtttacactgtttttccaagcgatcacagctgatatctcctggtgctagccccaaactgccactcttaactcttgaagtaaataaataatctttgctggcaggactatgccaaatctccttaagcactctctaatcagacctcctgagtcgtcccaattcttagaccttttatacctgtttttctccttctgttattccatttagtttttcaattcatacaaaaccgtatccaggccatcaccaatcactctatatgacaaatgtttcttctaacatccccacaatatcaccccttaccacaagacctcccttcagcttaatctctcccactctaggttcccacgccgcccctaatcccgcttgaagcagccctgacaaacatcatccattctctctccataccaccccccaaaaattttcgccgccccaacactgcaacactattttgttttatttttcttattaagaaggcaggaatgtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcccggctcatcctggctcaaaagcacccccactgagcaccttgcgaccccaactcctgcgcactgagcaccttacgacccccactcctacccgccagagaacaaaccccctttgactgtaattttcctttacctacccaaatcctataaaacggccccacccttatctccctccgctgactctcttttcggactcagcccgcctgcacccaggtgaaataaacagccatgttgctcacacaaagcctgtttggtggtctcttcacatggacgcgcatgaaa

SEQ ID NO: 302 - DNA, 438 bp, Homo sapiens; identical to SEQ ID NO: 266

SEQ ID NO: 303 - DNA, 663 bp, Homo sapiens
ttacagtaggtaactagacagacatgagcagagcaggagagggctcccctcgtccccaccaccacacgcaccaggaatatcaggtgaccatcaggtgatggtcaggcggttgttaactgcctctctaaaataataattggttgcagttggtgccagggaaaggcaatgtcttaatagataggaaaaacctgaaactggcaaccagtagcttcccagtaagatctcaggagctgggtgagtgggctcacacatgtttgctaagaggcaaaatgacagagtttaactggtatatcacctcctagaaacatttgacttgtcaggaaagaatgcctctatggagcgtgtgtacaactccaataaacacaccaactgagcttgctcccctcccaagtgctagtaggccactgtgcatgcagacagcccaccccaacaaaagaccccggaagtgtgccaacgtataaaaccccaagtcaaaggtcaaatagagcacttgatctctcaagttgcccgcttggccctcttccaagcatactttacttcctttccttcctgatctaaagctttttaataaacttccattcctgctctgaaacttgcctcagactctctttttgccttatccccctctgtccgattctttcttctgaggaggcaagaactcag

SEQ ID NO: 304 - DNA, 679 bp, Homo sapiens
gtaggtaatcagacagacgtgagaagggcaggagagccccccgaccccaccaggaatgtcaggcgaccatcaggtggtggtcaggtggttgttaaactctctaaaataataatcggttgcagcctgcaccaaggaaaggcagtctcccaatagacagaaaaatctgaaactggtgatcagcttcccagtaagacctcaggagttgggcaagtgggctcaagcatgcgcattaagaggcaaaatggtggagtttcactggtatatgatcttcctctaggaacacttgactggtaagggaagaatgcctcaagtgagcatgcgtacaatttcaggaaacacattgtggatgcggcccctcccagatcctggaaggccactgtgcacatggacagcccaccccatgggaagaatcagaggagaagggacgaaaccctccggaagcagaacaacctagaaaaccccaagtccgaggtcaaactgcacttgatctctcaagtcccccgctttgtcctcttacaagggaagtgtacttcctttcattcttgctctaaaactttttaacagagtttcactccttctctaaaacttacctgagtccctccctgtcccttatgccccttggttgaattctttcttcagaagaggcaagaattcagattgctgcagacctgtatggatt

SEQ ID NO: 305 - DNA, 413 bp, Homo sapiens
gtcaggcctctgagcccaagctaagccatcatatcccctgtgacctgcacgtacacatccagatggccggttcctgccttaacggatgacattccaccacaaaagaagtgaaaatggcctgttcctgccttaactgatgacattaccttgtgaaattccttctcctggctcatcctggctcaaaaagctcccccactgagcaccttgtgacccccacccctgtctgccaaagaacaaccccctttgactgtaattttcctttacctacccaaatcctataaaacggccccacccctatctcccttcactgactctctttttggactcagcctgcctgcacccaggtgaaataaacagccttgttgctcacacaaaacctgtttggtggtctcttcacacagacacgcgtgaaa

SEQ ID NO: 306 - DNA, 667 bp, Homo sapiens
tacagtaggtagctagtcagacatgagcagggcaggagagggctcccctgaccccaacaggaatgtcaggtgaccatcaggtgatgttcaaggttgttaactgtctctttaaaataataattggttgtagccagcgccagagaaaggcagtctcccagtagataggaaacatctgaaactggtgattagctgcttcctgatcagatctcaggagttgattgagtgggctcaagcatgcgtattaactggcatatgagcatctagggacgttggacttgcatgggaagaatgcctcaagtgagcatgcgtgcaactccagtaaacacaccgtgcatgcggcccctccaagtgctggcaggccaccacacatgcggacagcacaccccaaaggaagattcaggggagaaggaacgcaggcccctggaagtatgccagcatataaaaccccaagtcaaaggtcaaatagcacacttgatttctcaagtcgcccgcttggccctcctccaaattttacttcctttcattcctgctcgaaagctttttaataaactttcactcctgctctaaaacttgcctcagtctttccttctgctttatgcctccttggctgaattctttctttggaggaggcgagaactgaggttgctgcagacctgtttggattcgc

SEQ ID NO: 307 - DNA, 778 bp, Homo sapiens
caggactagctggatttcctaggctgactaagaattcctaagcctagctggggaaggagaccacacccacctttaaacaccgggcttgtaactcagctcaaacccgccccatcaggtagtaaagagggctcactaaaataccaattaggctaaaagcaggaggtaaagaaataatgaaatcatctatcacctgagagcacagggggagggacaatgatcgggatacaaacccaggcatttgagccagatgggcaaacccatttgggtcccctcccattgtatggaagctctgttttcactctgttaaatcttgcaacttcacattcttctgctccctgcttgttccagcctgagctgagctatcgctcgccgtccaccactgctgatcgccattgttgcagacccgctgttgacttccacccctctggatctggcgggatgtctgctgcgtttctgatctagggaggcgcccattgccgctcccgttcaggctagaggcttgcggttgttcctgcgcagctaagggcccgggttcgtcctaatcgagctgaacactaatcgctgggtttcgcggttcttttctgtgacccacggcttctaatagagctgtaacactcaccgcatggcccaaagttccactccttggaatccgtgaggccaagaacctcaggtcagagaacaaaaggcttgctgccatcatgggagtggccgccactatcttgggagcggcccatcaccatcttgggagctctaagaacaaagacccactggtaacatt

SEQ ID NO: 308 - DNA, 1443 bp, Homo sapiens
ttagagtaggtatctaggcagacatgaggagggtaggagaggatgccccattcccttccccagtaatgtcaagtgacaaataggtggtggtcaagtggttgttaaactgtctttctgaaataataattggttgtagctggcgccagggaaaggtggtttcccaatagacagaaaacacctgaggctggtgataagcagcttcctgataagatctcaggagttgggtgagtgggctcaagcatgtgcactaagaggcaacatggcagagtttaagtggtatttcttttttgttttgtttttgatggagtcttgctctgtcgcccaggctggagtgcagtggagtgatctcggctcactgcaatctccaactcccaggttcaagggattctcctgcctcagcctcccaagtagctgggattacaggtacacaccacaacgcccagctaattttttttttttatttttagtagagacggagtttcaccatgttggccaggatggtcttgatctcttgacctcatgatctgcctgcctcagcctcccaagtgttgggattacaggtgcgagccaccgcgcccggccccagctagtttttatatttttagtagaggggggtttcaccatgttagccaggctggtcttgaactcctgacctcaagcaatcctcctgccttggcctcccaaagtgttgggattacaggcgtgagccactgcacttggccaacagatctatgtcttcccaggaaccctcagctggtaggggaagaacgcctcaaacgagcatgtgcacaacttcagtaaatatactgttcccaccccaagggaaaatcaagggagaagagacgcaacccccggaaccatgccaatgtataaaaccccaagtcaggggctcaacagtgcacttgaatctctcaagttgcctgcttggccctcttccaagtgtactttacttcctttctttcctctaaaactttttttaaaaatttatattaattaattatttttgagacagagtcttgctgtgtcatccaggctggagtgcagtggtgtgatctcagctcactgcaacctctgcctcctgggttcaagtgattctcctgccttagcctccccagtagctaagattacaggcgcccgacaccacgcctggcaaattttcgtatttttagtagagacggggtttcgccatgttggccaggctggtcttgaactcctggcctcaagcaatccgcccatctcagcctcccaaagtgctgggattataggcatgagctgtcccgtgcccggcctcgttcctgttctaaaactttttaataaactctgactcctgctcaaaaacttgcctcagtctctcactctgccttatgcccctcagaggaattatttccttcgaggaggcaagaattgaattgctgcagacccgtgtggattcgctgctgctaa

SEQ ID NO: 309 - DNA, 5736 bp, Homo sapiens
aaaagttcacattgtaaatgtgtagcagatctttaatggcttggtcaacacaaaatattggctacaatcaattacaggtggtaatatatcctgaaagattaaaattagaaaaaaaaggtccagaaccatcagggccatttggggctaaaaccaggatggccacctcctcctcagccgagtgagtgctggaggagggagcctgaaactaggctcactgtgactcatttgtggcacccattattgcccaacctgcagttcactatggtgaaggagcaattcagactcaccctgcagcatcccgtctgggtcaaacagtggctgctccctaaggaatagttgggggcgctacataaagtagtttaaaaactattgtaaaaaggacatgtttcaccaatgttctttccttagattctccagtgtttgtaattcataaaaattccagccgatggggcatgctgaccaacttaagagctgtcaatgcagtaattcaacccctggggggctctctcaactgggttgccctctctggccataatccccaaagatttgcctttaattataattcatctgaaggattgcttttttaccgctcctctggcaaaacaggattttgaaaaatttgcttttactataccagccataaataataaagaaccagccaccaggtttcagtggaaagtgttgcctcagggaaggcttaatagtccaactatttgtcagacttttgtagctcaagctcttcaaccagttagagacaaattttcagactattatatcattcattatgttgatgatattttgtgtgctgcaaaaaccagagacaaattaattggctgttacacatttctgcaaacagaggtttaaaacacagggctgacaatagcatctgataagattgagacctctactccttttcattatttcagagtgcaggtagaggataggaaaattaaaccacaaaaaatagaaataagaaaagacacattaaaaacattaaatgactttcaaaaattgctaggagatattaattggatttggccaactctaggcatccctacttatgccatgtcaaatttgttctctgtcttgagaggggatccagaattgaatagtaaaagaacattaactccagagacaactaaagaaattggattagttgaagaaaaaattcagtgagcacaagtaaatagaatacatcccttggcccaactccagcttgatttttgctactgtgcattctccaacagccattatcgttcaaaacgcaggtcttgtggagtggtccttccttcctcacagtacaattaatacttttacattgtactgggatcaaatagctacattaattggtcaggcgagattacgaatactaaaattgtgtggaagtgacccagaaaaaatcattctttctttaatcaagaaacaggttagaaaagcctttatcaattctgcttcatggtagattggtcttgctaattttgtggaaattattgacaatcattacccaaaaacaaaaatcttccagtttttaaaattggctacttggattttacctaaaattaccagacataaacatttacagaatgctctgatggtgtttactgatggttccagccatggaaaagcagcttacatcaggccaaaagaacgagtcattgaaactcaatattactcagctcaaagagcagagttggttgctgtcatttcagtgttacaaggttttaatcagcctattaacattgtatcagattctgcatatgtagtacaggctacaaaggatggtgagacagccctaatcaaatatagtattgatgatcagttaaaccagctgtttaatttgttacaaaaacactgtaaaaaaaagaaatttcccattttatattactcatatttgagcacatattaatttaccagggcctttaactgaagcaaatgaacaagctgactagctagtatcatctgcattcatagaagcataagaacttcatgccttgactcatgtaaatgcaacaggattaaaaagtaaaattgatatccataaaaacagccaaaaaatattgtacaacactggacccatgtcaagtcctaaacctgcacactcaggaggtaggagttaatcccagagttctatgtcctaatgcattatggcaaatggatgtcacacatgtactgtcgtttggaaaattgtcatttgtccatgtgacagttgatacttattcacattttgtatgggcaacctgccagacaggaaaaagtacttcccatgttaaaagacgtttattatcttgttttgctgtcatgggagttccaggaaaaattaaaacagataatgggccaggatactgtagtaaaacatttcaaaaattcttaaatcagtgaaaaattacacatacaacaggaatcccttataattcccaaggacagacactagttgaaagaactaatagaacactcaaagctcaattggtgaaacaaaaaaaggaaaaagacagtaagagtataacacttggtgaaacaaaaaaaaagaaaaagacagtaagagtataacactccccagatgcaacttaatctagcactctatactttaatttttttaaacatttagaaaaatccgacaagtacttctacagaacaacattttactgataaaaaggacagttcacataaaggaaaactgatttggtgaaaaaataataaaaataaaacatgaacaacaggaaaggtgataacatgggggagaggtattgcttgtatttccctaggaaaaaaacagcttctagtttagatacctacaacttacagaagaagttgccatccagcaaggaagtggagccactgacctgggcccagttcaaaaagctgacacagtatactgaaaaagcctgaagaaaacaagggtaatgtgaactccagagaatatactgcttgcagctttgatgactgtatcaatggtggtcagtctccccatgtcttcaggagcagctgcaacttattatacttactgggaccatgtgcctttcctgcccttaattcgggcagtcacatgaatagatagtcctactaaagtatatgttaataatagtgcatgggtaccaggccccacagatgatcgttgccctgccaaacctacaaaaagaaggaatgatgataaatatttccattggatatcattatcctcctacttgcctagggaaggcacccagatgcttaatgcctacaacccaaaattggttggtagaagtacctactgtcagtgccaccagtagatatacttatcacatggtaagtcgaatgtcactcgggcaacaaataaataatttacagtattcttcttatcaaagatcattaaaatttaggcctaaggggaaggcttgccccccaaaaattcccaaagaatcaaaagacctaaaagtcttagtttggaaagaatatgtggctgatactgcggtgatattacaaaacaatgaatttgtaactattacagactgggaccctcgaggccaattatattataattgtatgggccagactcactcatgttcacaagccccatccatctggcccattaatctggcctatgatagtaatttaaaaagctggaccaggtttataaaaggtgaaaatcaccctatccattaaaatggagtaaaaagagaatttcctcacctcgaccaaagttaattagtcctgttactggtcctgaacatccagaatgatgaaagcttactgtggcctcgcaccacattagaatttggtctgcaaatcaaactataggaacaaaaaatcgtaggccatattatactattaacctaaattccaatctgacaattcctttgcaaagttgtgtaaaactcctttatatgctagttgtaggaaacatacttattaaaccagattcccaaattgtaacctgtaaaaactgtagattgcttacttgcattgattcgacttttgattggcagcacagtattctgctggtgagggcaagagagggcgtgtagatccctgtgtccatggactgactgcaggaggcttccccatctgtccatcttttagcagaagtattaaaacgatttctaactagatccaaaggattcatttttactttgattgcagtgattgtgggtcccattgcagtcacagctactgctgcagctgctggaatttctttacactcctctgttcaaactgcagaatacgtaaataattggcaaaagaattcctcaaaattgtgaaattctcagacccaaatagataaaaaattggcaaaccaaattaatgatcttagacaaaccgtcatttgaaaggaagataggctcatgagcttggaatatctttttcagttacagtgtgactaaaatacatcagatttttgcattataccccaagcctataatgagtctgagcatcactgagacatagttagatgccatctacaaggaagagaagataatcttactttaaatatttcaaaatttcaaaaacaaatttttaagacaacaaaagcccatttaaatttggtgccaaaaactgaggcaattgtaaaagctgctgatggcctcacaaagcttaaccccgtcacttaggttaaaaccatcagaagttccactattgtaaatttcatattaatccttgtatgtctgttctgtctcttgttagtctacaggtgtatccaacagctccaaagaggcagcaaccagcgagaacgggccataatgacgatggcagttttgtcaaaaagaaaagggggatatgtagggaaaagaaagagatatcagactgttactgtatctttgtagaaaaggaagacataagaaactccattttgacctgtaccgtgaacaattgttttgccttgagatgctgttagtctgtaactttagccccaaccttgagctcacagaaacatgtgttgtatggaatcaaggtttaagggatccagggctgtacaagatgtgccttgttaacaatatgtttacaggcagtatgctgggtaaaagtcatcaccattctccattctctaggaagcaggggcacaatgcactgctgaaagccgcagggacctctgcccaggaaagccgggtattgtccaaggttctccccacgtgatagcctgagatatggcctcgtggaatgggaaagactggaccatcccccagcccgacatacgtgaagagtctgtgcagaagaaggattcatagaggaaggcctcttgcagttgagataagaggaaggcctctgtcccctgcctgcccctgggaactgaatgtctcggtataaaacccgattgtacatttgttctattctgagataggagaaaaactcccctgtgtcgggaggtgagacatgctggcagcaatgctgctctattactctttactccactgagatgtctgggtggagagaagcatacatgtggcccacgtgcacatccaggcatagtaccttcccttgaacttatttgtgacacagatttctttgctaacatgttttcttgctgaccttctccccactatcaccctgttctcctgccacattccccttgctgagatagtgaaaatagtaatcaataaatactgagggaactcagagaccggtgctggttcgggtcctcagtatgctgagcaccggccccccgggcccacttttctttctctgtactttgtctctgtgtcttatttcttttctcagtctcttatcctacctgatgagaaatacccacaggtgtggaggggc

SEQ ID NO: 310 - DNA, 76 bp, Homo sapiens
ttagagtaggtagctacccaggcatgagcagagcaggggaaggctcccccacaccaggaatgtcaggtgaccataa

SEQ ID NO: 311 - DNA, 5708 bp, Homo sapiens
gtcaggcctctgagcccaagccaagtcatcgcatcccctgtgacttgcacatatacgcccagatggcctgaagtaactgaagaatcacaaaagaagtgaaaatgccctgccccgccttaactgatgacattccaccacaaaagaaatgaaaatggccggtccttgccttaagtgatgacattaccttgtgaaagtccttttcctggctcatcctggctcaaaaagctcccccactcagtaccttgtgactcccacttctgcctgccagagaacaacgcccctttttcctttacctacccaaatcctataaaacggccccacccctatctcccttcactgaccctcttttcggactcagcccacctgcacccaggtgaaataaacagccttgttgctcacacaaagcctgtttggtggtgtcttcacacggacgcacatgaaatttggtgtcgtgattcggatcggaggacctcccttgggagatcaatcccctgtcctccggctctttgctccgtgaaaaagatccatctatgacctcgggtcctcagacccaccagcccaaggaacatctcaccgattttaaatcgggtaagcggcctcttcttactctcttctccaacctctctcactctccctcaaccactttctcctttcaatcttggtgccacccttcaatctctcccttctcttaatttcaattcctttccttttctggtagagacaggagacacgttttatccgtggacccaaaactctggcgccggtcacggacttgggaagacagtcttcccttggtgtttaatcacacggggacaactgcctgattattacccacgtttcagaggtgtctgaccacgcggggacgcctgccttggtccttcacccttagcagcaagtaccgcttttctggggggcaagaaccccccaaccccttctctccatgtctctaccccttctccactgttctgggggacaagaaccccccaaccccttctctctgtgtctctaccccttctctgcttttctgggggcaagaaccccccgatcctttatttccacaccccgctctgtgccccgatcccttatttctgcaccccgacttcttatctctgtgccccaaccccttatttccatgccccgacccctttcctgcttttctggaaggtaagaacccctgaaccccttccctccatgtctttactctcccttttctttaaacttgcctccttcactataggcaaccttccaccctccattcctccttcttctcccttagcctgtgttcttaagaacttaaaacctctcaactctcacctgacctaaaacctaaatgccttattttcttctgcagtgctgcttgaccaaaatacaaactcaacagtggttccaaatagcaagaaaatggcactttcaatttttccatcctacaagatctaaataattcttgtcgtaaaataggcaaatggtctgaggtgcctgacgtccaggcattcttttacacatcagtccctccctagtctctgttcccaaggcaactcgtcccaaatcctccttctttccctcctgcctgtcccctcagtcacaactccaaatgtcgctgagtctttctaatcttccttttctacagacccatctgacctcctcgccaggccgagccaggtcccagttcttcttcagcctctgctccccaccctataatccttttatcacctccattcctcacaccgggtccagcttacagttttgttcctcgactagtcttcccccacctgcccagcaatttcctcttaaaaaggtggctggagctaaaggcacagtcaaggttaacgctcctttttctttatccgacctctcccaaaatcagttagcatttaggctttttttcatcaaatatgaaaaacccagcccagttcatggctcatttggcagcaaccctgagacgctttacagccctagaccctgaaaggtcagaaggccgtcttattctcaatatgcattttattttttttacccaatctgctcccaacatgaaataaagctccaaaaattaaattccggccctcaaaccccacaacaggacttaattaaccccgccttcaaggtgtgcaataataaagtagaggcagccaagtagcaatgtatttctgagttgcaattccttgcctccactgtgagacaaaccccagccacatctccagcacacaagaactccaaacgcctgaacctcctcccccaggagcttgccacaagtgccggaaatctgaccactgggccaaggaatgcccacagcccgggattcctcctaagccatgtcccatctgtgcgggaccccactgaaaattggactgttcaactcacctggcagccacttccagagcccctggaactctggcccaaggctctccgactgactccttcccagatcttctcggcttagcagctgaagactgacgctgcccgatcgcctcggaagcctacaggaccatcacaaatactctgagtaactctcacagtggagggtaagtccatctccttcttagtcaatatggaggctacccactccacattaccttcttttcaagggcctgtttcccttgcctccataactgttgtgggtattgacggccaggcttctaaacctcttaaaactcccaaactctggtgccaacttagacaatactctttgaagcactcctttttagttatccccacctgcccagttcccttgttaggctgagacactttaactaaattatctgcttccctgactattcccggactacagctgcatctcattgccacccttctccccaacccaaagcctcctttgcatcttcttctcatatccccccaccttaacccacaagtatgggacatctctactccttccctggcaactgatcacatgcccattaccatcccattaaagcctaatcactcttaccctgctcaatgttaatatcccatcccacagcacgctttaaaaggattaaagcctgttatcactcacttgctacagcatggccttttaaagcctatatactctccttaccattcccctatttcacctgtcctaaaaccagacaagtcttataggttagttcaggatctgtgccttatcaaccaaattgttttgcctatccacccccgtggtgccaaacccatatactctcctatcctcaatacctccttctacaacccattattcttttctggatctcaaacatgctttctttactattcctttgcacccttcatcccagcctctctttgctttcacttggactgaccctgacacccattaggctcagcaaattacctgggctatactgccgcaaggcttcacagacagcccccattacttcagtcaagcccaaatttcatcctcatctgttacctatctcggcataattctcacaaaaacacacgtgctttccctgctgattgtgtctgactaatctcccaaacctcaatcccttacaaaacaacaactcctttccttcctaggcatggttagtgtggtcagaattcttacacaagagccgggaccacaccctgtagcctttctgtccaaacaacttgaccttactgttttagcctagccctcatgtctgcgtgcagcagctgccactgctctaatacttttagaggccctcaaaatcacaaactatgctcaactcactttctacagttctcataatttccaaaatctattttcttcctcacacctgacacttatactttctgctcccccggctccttcagttgtacccactctttgttgagtcccacaattaccattgttctcggcccggacttcaatccggtctcccacattattccagataccacacctgaccctcatgactgcatctctctgatccacctgacgttcaccccatttccccacatttccttcttccctgtttctcaccctcatcacatttggtttattgatggcagttccaccaggcctaatcaccactcaccagcaaaggcagactatgctatagtactagccactagcccgcctcttagaacctctcatttcctttccatcgtggaaatctatcctcaaggaaataacttctcagtgttccatctgctattctactactcttcatggattattcaggccccctcccttccctacacatcaagctcggggatttgcccccgcctaggactggcaaattggctttactcaatatgccccaagtcagaaaactaaaatacctcttagtctgggtggacactttcactggatgggtagaggcctttcctacaggatctgagaaggccactgcggtcatttcttcccttctgtcagatataattcctcagtttggccttcccacctctatacagtctgataacggaccagcctttattagtcaaatcagccaagcagtttttcaggctcttggtattcagttaaacctttatatcccttacggtcctcagtcttcaggaaaggtagaacggactaatggtctttaaaaaacacacctcaccaagctcagccaccaacttaaaaaggactggacaatacttttaccactttcccttctcagaattcaggcctgtccttggaatgccacagggtacagcccgtttgagctcctgtttggacgctcctttttattaggccccagtctcattccagacaccaaaccaagttggactgtgccccaaaaaacttgtcatccctactatcttctgtctagtcatactcctattcaccgttctcaacgactcatacatgccctgctcttgtttacactgccggtttacactgtttctccaagccatcacagctgatatctcctggtgctatccccaaaccgccactcttaactcttaaagtaaataaataatctttgctggcaggactatgctgaatctccttaggcactctctaattagatgtcctgggtcctcccaattcttagacctttaatacctgtttttctccttctcttattccatttagtttttcaattcatacaaaaccatatccaggccatcaccaataattctaaatgacaaatgtttcttctaacaaccccacaatatcaccccttaccacaagacctcccttcagcttaatccctcccactctaggttcccacgccgcccctaatcccgcttgaagcagccctgagaaacatcacccattctctctccataccacctcacaaaaattttcgccgccccaacacttcaacactgttttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaatgccctgccccgccttaactgatgacattccaccacaaaagaagtgaaaatggccggttcttgccttaagtgatgacattaccttgtgaaagtccttttcctggctcaaaaagctcccccactcagtaccttgtgacccccacccctgcctgccagagaacaacgcccctttttcctttacctacccaaatcctataaaacggccccacccttatctcccttcactgaccctcttttcggactcagcccacctgcatgcacccaggtgaaataaacagccttgttgctcacacaaagcctgtttggtggtctcttcacatggacgcgcatgaaa

SEQ ID NO: 312 - DNA, 6042 bp, Homo sapiens
gccaggcctctgagcccaagctaagccatcatatcccctgtgacctgcatgtacacatccagatggccggttcctgccttaactgatgacattccaccacaaaagaaatgaaagtggcctgttcctgccttaactgatgacattatcttgtgaaattccttctcctggctcatcctggctcaaaagctcccctactgagcaccttgtgaccgccccccctgcccgccagagaacaacccccctttgactgtaattttcctttacctacccaaatcttataaaacggccccacccctatctcccttggctgactctcttttcggactcagcccgcctgcacctaggtgaaataaacagccttgttgctcacacaaagcctgtttggtggtctcttcacacagacgcgcatgaaatttggtgctgtgactcagattggaggacctcccttgggagatcaatcccctgtcctcctgctctttgctctgtgaaaaagatccacctacgacctcgggtcctcagacccaccagcccaaggaacatctcgccaattttaaatcgggtaagcggcctcttcttactctcttctccaacctctctcactatccctcaaccactttctcctttcaatcttggcgccacccttcaatctctccctctcttactttcaattcctttcattttctggtagagacaaaggagacacattttatccttggacccaaaactctggcgccagtcacggactaaggaaggcagccttcccttggtgtttaatcattgcagggacacctctctgatttttcacccatgtttcagaggtgtctgaccacatggggacacctgccttggtccttcacccttagcagcaagtactgcttttctagggggcaagaaccccccaaccccttctctccatgtctctactcctctgcttttctagagggcaagaacccccccaaccccttctccttcacccttagctgcaagtaccacttttctagggggcaagaaccccccaaccccttctctccgtgtctctaccccttctctgcttttctgggggcaagaacccccgatcccttatttctgtgccccaacctcttatctctgtgccccatcccttatttccacgccctgaccccttatctctgagccccgatcccttatttccatgccccgacctcttatctctgcgccccgatcccttatttccgcaccccaacctcttatctctgtgccccgatcccttatttccacaccgcaatcccttatttccgcaccctgacctcttatctctgcaccccaaccccttatttctgtgccccgacccctttcctgcttttctggagggtaagaacccccgaaccccttccctccgtgtctctactctcttttctctgggcttgcttccttcactatgggcaaccttccaccctccattcctcctccttctcccttagcctgtgttcttaagaacttaaaacctcttcaactctcacctgacctaaaatctaagcatcttattttcttctgcaatgctgcttgaccccaatacaaactcaacagtagttccaaatagccagaaaatggcacttttaatttttccatcctacaagatctaaataattcttgtcataaattaggcaaatggtctgaggtgcctgacgtccaggcattcttttacacatcggttcctccctggtctctgttcccaatgcaaccagtcccaaatcttccttctttccctcccacctgtcccctcagtcccaaccccaagcatcactgagtctttctaatcttccttttctacagacccatctgacctctcccctcctcaccaggcagagccaggtcccaattcttcctcagcctctgctcccccaccctataatccttttatcacctcccctcctcacaccttgtccggcttacagtttcattcctcaaccagccttcccccacctgcccagcaatttcctcttaaaaagatggctggatataaaggcatagtcaaggttaacgctcctttttctttatccgacctctcccaaaatcagttagcgtttaggctctttttcatcaaatatgagaaacccagcccagttcatggctcgtttggcagcaaccctgagacgctttacagccctagaccctgaaaggtcagaaggccatcttattctcaatatgcattttattttattacccaatctgctcccgacattaaataaaactccaaaaattaaattccagccctcaaaccccacaacaggacctaattaacctggccttcaaggtgtacaataatagagtagaggcagccaagtagcaatatatttctgagttgcaattccttgcctccactgtgagacaaaccccagccacatctccagcacaaaagaacttccaaacgcctaagtcgcagtggccaggcgttcccccaggcccgcctcccccaggagcttgctacaagtgccagaaatctggccaccaggccaaggaatgcccgcagcccacgattcctcctaagccgcgtcccatctgtgcaggaccccactgaaaatcagactgttcaactcacctggcaaccagtcccacagcccctagaactctggcccaaggctctctgactgactccttcccagatcttctcggcttagcagctgaagactgaaactgcccgattacctcagaagcttacaggaccatcacagatgctctaggtaactcttacagtggaaggtaagccgtccccttcttaatcaatatggaggctacccactccacattaccttcttttcaagggcctgtttcccttgcctccataactgttgtaggtattggcggccaggcttctaaacctcttaaaactccccaactctggtgccaacttagacaatactcttttaagcactcctttttagttatccccacctgcccagttcccctattaggctgagacactttaactaaattatctgcttccctgactgttcctaggctacagccacacctcattgccaccttttcccccagttcaaagcctccttcacatcctccccttgtatctccccaccttaacccacaagtataagacacctctactccctccttagcaaccaatcatccaccccttaccatctcattaaaacctaatcactcttaccccgctcaatgccaatatcccatcccacagcacactttaaaaggattaaagcctgttatcactcacctgttacagcaaggccttttaaagcctataaactctccttacaattcccccattttacctgtccaaaaaccagacaagccttacaggttaattcaggatctgcaccttaccaaccaaattgttttgcctatctaccctgtggtgccaaacccatatactctcctatcctcaatacctccctccacaacccattattctgttctagatctcaaacatgctttctttactattcctttgcacccttcatcccagcctctcttcgctttcacttggactgaccctgacacccatcaggctcagcaaattacctgggctgtactgccacaaagcttcacagacagcccccattacttcagtcaagcgcaaatttcttcctcatctgttacctatctcggcgtaattctcataaaaacacatgtgctctccctgctgatcatgtccagctgatctctcaaaccccaacaccttctacaaaacaacaactcctttccttcctaggcatagttagatacttttgactttagatacctggttttgccatcctaacaaaaccattatataaactcacaaaaagaaacctagctgacccatagattctaaatcctttccccactcctctttccattccttgaagacagctttagagactgcccccaccctagctctccctgactcatctcaacccttttcattacccacagctgaagtgcagggctgtgcagtcagaattcttacataaggaccaggatcacgtcctgtagcctttttgtccaaacaacttcaccttcctgttttaggctggccatcctgtctccgtgcagtggctgctgccgccctaatactttagaggcccttaatataacaaactatgctcaactcactctctacagttctcataacttccaaaatctattttcttcttcacacctgacacatatattttctgctccccggctccttcagctgtactcactctttgttaagtctcccacaattaccactgttcctggcccagacttcaatccggcctcccacattattcctgataccacacctgtcccctatgactgtatctctctgatccacctgacattcaccccatttccccatatttccttctttcctgttcctcaccctgatcacacttggtttattgatggcagttccaccaggcctaatggccacacaccagcaaaggcaggctatgctatagtacaagccactagcccacttcttagaacctctcatttcctttccatcatggcaatctatcctcaaggaaataacttctcagtgttctatctgctattctactactcctcaaggattattcaggccccctcccttccctacacatcaagctcggagatttgcccctacccaggactggcaaattggctttactcaacatgccccgagtcagaaaacaaaaatacctcttagtctaagtagacactttcactggataagtaaaggcctttcctacaaggtctgagaaggccactgctgtcatttcttcccttctgtcagacataattcctcggtttggccttcccacctctatacagtccaatagcagactggcctttattagtcaaatcagccaagcattttttcaggctcttagtattcagtgaaacctttatatcccttacagtcctcagtcttcaggaaaggtagaacggactaatggtcttttaaaacctcaccaaactcagccaccaacttaaaaaggactggacaatacttttaccactctccgttctcagaattcaggcctgtcctcagaatactacagggtacagcccatttgagctcttgtatagatgctcctttttattaagccccagtctcattccagacacaagaccaacttggactgtgccccaaaaaacttgtcatccctactatcttctgtctagtcatactcctattcactgttctcaactactcatacatgccctgctcttgtttacactgccagtttacactgtttctccaagccatcacagctgatattggtgctatccccaaactgccactcttaactcttaaagtaaatgaataatctttgctggcaggactatgctgaatctccttaggcactctctaattagatgtcctaagtcctcccaattcttagacctttaatacctgtttttctccttctcttattccgtttagtttttcaattcatacaaaaccatatccaggccatcaccaataattctaaatgtttcttctaacaatcccacgatatcaccccttaccacaaaatcttcagcttaatctctcccagtctaggttcccatgccgcccctaatcccgctcgaagcagccctgagaaacatcgcccattatctctccataccacccccaaaaatttttgccatcccaacactttaccactatttcgttttatttttcttattgatataagaagacaggaatgtcaggcctctgagcccaagctaagccatcatatcccctgtgacctgcatgtacacatccagatggccagttcctgccttaactgatgacattatcttgtgaaattccttctcctggctcttcctggctcaaaagctcccctactgaccaccttgtgacccccactcctgcccaccagagaacaacccccctttgactgtaattttcctttacctacccaaatcttataaaacggccccatccctatctcccttggctgactctcttttcggactcagcctgcctgcacccaggtgaaataaacaaccttgttgctcacacaaagcctgtttggtggtctcttcacatggacgcgcatgaaa

SEQ ID NO: 313 - DNA, 954 bp, Homo sapiens
gtggggaaaagaaagagagatcagattgttactgtgtctgtgtagaaagaagcagacataagagactccattttgttctgtactaagaaaaattcttctgccttgagatgctgttagtctgtaactttacccccaaccctgtgctccctgaaacatgtgctgtgtcaatttagggttaaatggcttaagggctgtgcaagatgtgctttgttaaacaaatgcttgaaggcagaatgcttgttaagagtcatcaccactccctagtctcaagtacccagggacacaaaacactgcggaaggccgcagggacttctgcctaggaaagccaggtattgtccaaggtttctccccatgtgatagcctgagatatggcctcgtgggaacggaaagacctgaccatcctccagcccgacaccctgtgctgaggaggattagtaaaagaggaaggaactcctctttgcagttgagacaagaggaaggcatctgtctcctgcccgtccctgggcaatggaatgtctctgtgtaaaacccgattgtatattccacctactgagataggggaaaaccaccttagggctggaggtgggacaggcaagcagcaatactgctcaaggcattgagatgtttatgtatatacatatctaaagcacagcacttaattctttacccagttaatgatgcagagacctttgttcgtgtgtttacctgctgaccttctctccactattatcttatgaccctgccacatccccctctccgagaaacacccaataatgatcaataaatactaagggaactcagaggccggtgagatcctccttgtgctgaaggctggtctcttgggccccctttttctttctctatactttgtttctgtgtctctttcttttccaagtctctcgttgcacctaacaagaaaaacccacaggtgtggaggggcaacccaccccttca

SEQ ID NO: 314 - DNA, 1693 bp, Homo sapiens
tttccccctttcctgttccccacccagaccacacttggtttactgatggtagttcttccaggtccaattgccaatcaccggcaaaggcaggttatgctatagtgtcttccacatctatcattgaggctacagccctgcccccttccactacctctcaacaagcagaactcattgccttaacttaagccctcattcttgcaaagggactagctgtcaatatctatactgattccaagtatgccttccacatcctttaccaccatgctgttatatgggcagaaagaagtttcctcactacacaggggtcctccatcattaacacctccttaataaaaactcttcttaaagctgctctacttccaaggaagctagggtagttcactgcaagggccatcaaaaggcatcagatcccattgctcagggcaacgcttatgctgataaggtagctaaagaagcagttagcattccaactttggtccctcatggtcagtttttctcgttctcatcttttcactttacatttccagttatgccttacaaaggtcccttcttcctctgtggctcctccacctacatgtgtctacctattaattggacaggcacatgtacactagtttcctttactcccaaaaatcatttcacaaataggactgaacagcttcctgttcccctcatgacaccaacacttcaccactattttgttttatttttcttattagtataagaagacagaaataggccttgaattactgctgaaaaaggaggactctaaatttttaaatgaagggtgttgttttgacctaaatcaatctggcctggtataggacagcataaaaaaatcacaaggattgagccccaaaactcaccaaccaagcaaataattacactgaaccccttgggcactctctatttggatatcctgggtcctccccaattcttagtcctttaatacctgtttttctccttctcttatttggaccttgtgtcttctgtttagtttctcaactcatacaaaactacatcaaggccatcaccaatcattctatatgacaaatgctccttctaacaaccccacaatataaccccttgccccaaaatctttcttcagtttgacctctcccactctaggttcccacgccacccctaataccacttgaagcagccctgagaaacatcacccattatctctccataccatcccccaaaattttcaccaccccaacacttcaccactattttgtttgttttccttattaatataagaagacaggaatgtcaggattctgagcccaaccctgcacatacgtatacatccagatggcctgaagcaactaaaaaaccacaaaagaagtaaaaatagccaattcctgccttaactgatgacatcccaccattgtaatttgttcctgccccaccctaactggtcaattgaccttgtgaaattccttctcctggacaatgagtctcagaacctccccacagagcaccttgtaacccctgccctgcctgcaagagaaaaaccccctttgactgtaattttccactacctacccaaagcctataaaattgccccacccctatctccctttgctgactcctttttcagactcagtctgcctgcctccaggtgattaaaaagctttattgctcacacaaagcctgtttggtcatctcttcacacggacatgcatga

SEQ ID NO: 315 - DNA, 576 bp, Homo sapiens
ttacagtagatagtagatgtgagcagggcaggagagggcccctcccacccccacagggaatgttagacaaccatcagttgatgatcagatagttgttaagctgtctcgctaaagtaataattggtcacagctggtaccagcgaaaggcagtctcccagtagacagaaacaccagaaactagaaactggtgatgggcggcttcctgataagatctcaggagttaggtgagtgggctccagcatgcccactaagaggcaaaatggcggagtataactggtatatgaccttcttctagaagcactcaactggtaaggaaaggacgcctcaagtgagcatgtgtacaactccagtaaacgtactgtgcatgcggcccctcccaagtgctggcaggccactgtgcatgtggacagcccactccaagggaagaatcaagggagaagagacacagaccccggaagaatgctgaggtagaacaccccaagtcaaaggtcaaatcacacacttgaatctctcaagtcatcttcttggccctcttccaagtgtactttacttcctttcattcctgctctaaaattt

SEQ ID NO: 316 - DNA, 716 bp, Homo sapiens
gtcaggcctctgagcccaagcttagccattatatcccctgtgacctgcacatatacatctagatggcctgaagcaactgaagaaccacaaaagatgacattccaccattgtgatctgttcctgccccaccctaactgatcaattgaccgtatgacaatacaccctccccgcccttgcgataacgtactttgtaatattctccctgcccttgagaatgtacgttgtgagatccaccccctgcccacaaaaaaattgctcctaactccaccgcttatcccaaacgtataagaactaatgataggctgggtgccgtggctcacgcctataatcccagcactttgggaggccgaggcaggaggatcacaagatcaggagttcgagaccagcctggccaatatggtgaaaccccttctctactaaaaatacaaaaattagctgggcgtggtggcaggtgcctgtagttccagctacttgggaggctgaggcaggagaatcgcttgaacctgggaggcagaggttgcagtgagctgagattgcgccattgcactgtagcctgggcgacaaagtgagactccgtctcaaaaaaaaaaaaaagaaaaaactaatgataattccataccctttgctgactctcttttcagactcagcccgcctgcacccagctttattgctcacacaaagcctgtttggtagtctcttcacactgacgcgtgtga

SEQ ID NO: 317 - DNA, 257 bp, Homo sapiens
aattccagacattgtatgaggaagcattgcaaaactttctgttctgttagctgttgcctgtagcccccagtcatgttccccacgcttgctcgatctctcactaaactttcacgtagacccttagagttacaagcccttaaaagggccaagaatttctttttcagggacctcggttgcaagtctgccgaagttcccggcctaatacagcccttctttaatccggtgtctgagttttgtctgcggctcgtcctgctgca

SEQ ID NO: 318 - DNA, 70 bp, Homo sapiens
tcccggctgaataaagccatttctttaacccagtgtctgaggggttttgtccggggctcatcctgctaca

SEQ ID NO: 319 - DNA, 579 bp, Homo sapiens
ataataattgatctcagcgggcaccaagaaaaggcagtctcccaatagatagaaaacacccgaaactggtcatcagcagcttcccgataagatctcaggagttggatgagtgggctcaagcatatgcactaagaggcaaagtggcagagtttaactggcacataatcttcctctaggaacactctaaaagtaagagaaaaacacctcaaatgagcatgtgcacatttcattaaacccattgtgtacgcggcccctccgaagcactggcaggccactgtacatgtggacatcccaccccaaaggaaaaatcaagggagaagaaatacaaatcccagaaccatgccaatgtataaaaccccaagtcaagggccaggcagagcacttagatctctcaagtcacccacttagccatcttccaagtgtactttacttcctttcgttcccactctaaaactttaataaacatttactcctgctctaaaacttgcttgggtctctcactcttctgcatgccccttggccaaattctttcctccaaggaggcgagaatcaagttgctgcagacctgtatggattcgc

SEQ ID NO: 320 - DNA, 426 bp, Homo sapiens
gtaggagataggtcgggtggtgggaaaaattgtagaaagatgcaaaccttcttggaaggccgggaggttttacaaaagttaggatttggctgaaggcaaccagattctcttatctggttcctgaaagcttaggttagataacaaggggatgtaaaaaaactgatctagataagttagtttacttaggccttggaacctggcctttaatcatccatgcacaattacttacaagtatgttgactcaaggcctttgtcattaaatctgtactaaataaatgcctgcagcaccagcatgtcagggctgtggctgctacaactctttctgtgaacggcccggtcccctagcccgctccttcactggatgtctgtgttggagtgcattttttcatccattacttggtcagggtctgcgggtgagacctggca

SEQ ID NO: 321 - DNA, 5617 bp, Homo sapiens
gtcaggcctctgagcccaagctaagccatcatatcccctgtgacctgcatgtacacatccagatggccggttcctgccttaactgatgacattccaccacaaaagaagtgcaaatggcctgttcctgccttaactgatgacattgtcttgtgaaattccttctcctggctcatcctggctcaaaagctcccctactgagcatcttgtgacccccgactctgcccgccagagaacaacccccctttgtaattttcctttacctacccaaatcctataaaacggccccaccccatctcccttccctgactctcttttcggactcagcccgcctgcacccaggtgaaataaacagccatgttgctcacacaaagcctgtttggtggtctcttcacacagacgtgtatgaaatttggtgccgtgacttggattgggggacctcccttgggagatcaatcccccgtcctcctgctctttgctctgtgagaaagatccacctatgcctcaggtcctcagactgaccagcccaagaaacatctcaccaatttcaaatcgggtaagccccctcttcttactctcttctgcaacctctctcactgtttctcagcctctttctcctttccactcttcaatctctcccttcttttaatttcaattcctttcattttctggtagagacaaaggagacacattttattggtggacccagaactccggcgctggtcattgactgggaaggcagccttcccttggtgtttaattattgcagggatgcctctttgattattcacccaggtttcagaggtgtcagaccacgcagggacgcctgccttggtccttcacccttagtggcaagtcccacttttctggggaaggggcaagtaccccaaccccttctctccgtgtctctaccccttctccacctttctggggggcaagaaacccccaaccccttctccttcacccttagtgacaagtcccgcttttctgggggaggagcaaataccccaaccttgtatctctgcaccccaatcccttatttccatgccccgacctcttatctcggtgccccaaccccttatttccacaccccaacccctttcccgcttttgtggagggcaagaaccccccaccccttctccgtgtctctattcttttctctgggcttgcctccctcactatgggcaagcttccaccttccattcctccttcttctcccttagcctgtgttcttaagaacttaaaacctcttcaactatcacctgacctaaaatcttaagtgtcttattttcttctgcaatgccacttgaccccaatacaaactcgatagtagttccaaatagccagaaaatggcactttcaatttttccatcctacaagatctaaataattcttgtcataaaatgggcaaatggtctgaggtgcctgacgtccaggcattcttttacacatcggtcccttcctagtctctgtgcccaatgcaactcgtcccaaatcttccttctttccctcccacctgtcccctcagtcccaatcccaagcgtcactgagtctttctaatcttccttttctacagacctatctgacctctcccctcctggccaggccgagctaggtcccaattcttcctcagcctcagctcctccaccctataatccttttatcacctcccctcctcacacccagtcaggcttacagtttccttccatgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacttgtttggcagcaaccctgagacactttacagctctagaccctaaaatgtcaaaaggccgtcttattctcaaaatacattttattacccaatctgctcccgacattaaataaaactccaaaaattaaattccggccctcaaaccccacaacaggatttaattagcctcaccttcaaggtgtacaataatagaaaacagttgcaattccttgcctccactgtgagacaaaccccagccacatctccagcacacaagaacttccaaacacctgaaccgcagcagccaggcattcctccagaacctcctcccccagtagcttgctacaagtgccagaaatctggccaccaggccaaggaatacctgcagcccaggattcctcctaagccacgtcccatctgtgcgggaccccactggaaatcggactgtccaactcacctggcagccactcccagagcccctggaactctggcccaaggctctgactccttcctgggtcttcttggcttagcagctgaagactgatggtggctgatggcctcggaagccccctagaccatcacggatgccaagcttccagtaactctcacagtggagggtaagtctgtccccttcttaatcaatacggaggctacccactccacattaccttcttttcaagggcctgtttcccttgcctccataactgttgtggttactgacggccaggcttctaaacctcttaaaactccccaactctggtgccaacttggacaacactcttttatgcactcttttttagttatccccacctgcccagttcccttattaggccgagacactttaaccaaattatctgcttccctgactattcctggactacagctgcatctcattgccacccttctccccaacccaaagcctccttcgcgtcttcctctcgtatccccccaccttaacacacaagtatgggacatctctactccttccctggcaaggatcacatgcccattaccatcccattaaaacctaatcacccttaccccgctcaatgccaatatcccatcccacagcacgctttaaaaggattaaagcccgttatcactcgcctgctacagcatgggcttctaaaacctataaactctccttacaattcccccattttacctgtccaaaaactggacaagtcttacagattagttcaggatctgcgccttatcaaccaaattgttttgcctatccatcctgtggtgcccaacccgtacactcttttgtcctcaataccttcctccacaactcactattccgttctcgatcttaaagatgcttttttcactattcccctgcacccctcatcccagcctctctttgctttcacttagactgaccctgacacccatcaggctcagcaaattacctgggctgtactgccgcaaggcttcacagacagcccccattacttcagtcaagccgaaatttcatcctcatctgttacctatctcggcataattctcataaaaacacacgtgctttccctgctgatcatgtccgattaatctcccaaacctcaatcccttacaaaacaacaactcctttccttcctaggcatggttagtgcagtcagaattcttacacaagagccaagactgcaccctgtagcctttctgtccaaacaacttgaccttactgttttagcctagccttcgtgtctccgtgcagcagctgctgccactctaatactttcagaggccctcaaaatcacaaactatgctcaactcactctctacatttctcataacttccaaaatctattttcttcctcatacctgacacatatactttctgttccctggctccttcagctgtactcactctttgttaagtcccacaattaccattgttcctggcccagacttcagtccggcctcccacattattctggataccacacctgaccctcatgactgtatctctctgatccacctgacattcaccccatttccgcatatttccttctttcctgctcctcaccctgatcacgcttgatttattaatggcagttccaccaggcctaatcgccacacaccagcaaaggcaggctatgctatagtacaagtcactagcccgcctcttaaaacctctcatttcctttccatcgtggaaatctatcctcaaggaaataacttctcagtgttccatctgctattctactactcctcaaggattattcaggcccccctcccttccctacacatcaagctcgaggatttgcccccacccaggacttgcaaattagctttactcaacatgccccgagtcagataactaaaatacctcttagtctaggtagacactttcactggataggtagagtcctttcctacagggtctgagaaggccactgcagtcatttcttcccttctgtcagacataattcctcagtttagccttcccacctctatacagtctgatagcagaccagcctttattagtcaaatcagccaagcattttttcaggctcttagtattcagtgaaacctttatatcccttacagtcctcagtcttcaggaaaagtagaacagactaatggtcttttaaaaacacacctcaccaagctcagccaccaacttaaaaaggactagacaatacttttaccactttcccttctcagaagtcagacctgtcctcagaatgctacagtgtacagcccatttgaggtcctgtatagatgctcctttttattaggccccagtctcattccagacaccagactaacttagactgtgccccaaaaaaacttgtcatctctactatcttctgtctagtcatactcctattcaccgttctgaactactcatacatgctctgctcttgtttacactgccagtttacactgtttctccaagccatcacagctgatgtctcctggtgctatccccaaactgccactcttaactcttgaagtaaataaataatctttgctggcaggactatgctgaatttccttaggcactctctaattagatgtcctacgtcctcccaattcttagacctttaatagctgtttttctccttctcttattccgtttagtttttcaattcatacaaaactgtatccaggccattaccaataattctaaatgacaaatatttcttctaacagtcccacaatatcaccccttaccacaaaatcttccttcagcttaatctctcccactctaggttcccatgctgcccctaatcccactcaaagcaccctgagaaacatcgcccattgtctctccataccacccccaaaaattttcaccgccccaacactttaccactatttcattttatttttcttattaatataagaagacaggaatgtcaggcctcggagcccaagctaagccatcatatcccctgtgacctgcatgtacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactctgcccgccagagaacaacccccctttgactgtaattttcctttacctacccaaatcctataaaacggccccaccccatctcccttcactgactctcttttcggactcagcccgcctgcacccaggtgaaataaacagccatgttgctcacacaaagcctgtttggtggtctcttcacacggacgcgcatgaaa

SEQ ID NO: 322 - DNA, 212 bp, Homo sapiens
ttacagtaggtagctaggcaggcatgagcagggcggtggagggctccccctcaacacacaccaggagtgtcaggcaaccagcaggtgatggtcaggcggttgttaactgtttctctgaataattggtcacagccagcggcagggagaggtagtctcctaatagatagaaaacatctgaaactggtcagcagcttcccaataagatctcagga

SEQ ID NO: 323 - DNA, 699 bp, Homo sapiens
tacagtaggtagcttgtcagacactaatagggcaggagagggcccccacctcccaccaggaaagtcaggtgaccattaggtgatggtcaggcagtttgtcacactgcctctctaaaataataataggtcacagccagtgccagggaaaggtagtctcccagtagatagggaacacctgaaactggtgatcagcagctttctgataagatctcaggagttgggtgagtgggctcgagcatgcacattaagaggcaaaatggcgaatatgaccttccaaggacattctgctgataagggaagaatgcctcaagtgagtgtgctcgtaacaccagtaaacacactgtgcatgctcccctctgaagtgctagcaggccacagggatgtggacaattcacccccacggaagaatcaggggagaagggatgcaagaccctggaagtacgccaatgtataaaaccccaagtcaagatgtcaaaccccacacttgtccttcaagtcacccccttggccctcttccaagtgtacctttcttctctttgttgctgctctaaagctttttaataaactttcactcctgctctaaaacttgcctgggtctcttattctgccttatccccctccgttgaattctttcttctgaggaagcaagaattgaggttgctgccaacctgtacggatttgctatcagtaacagaaata

SEQ ID NO: 324 - DNA, 1972 bp, Homo sapiens
tacagtaggtagccgaacagacatgagcaggcagaactgtcccccacccccaccaggaaagtcaggtgatcatcaggtgatggtcaggcaggtgttaagctgtctctctcagatgataattggtcgcagccgcaccaggtaagggcagtctcccaatagaaatacctgaaactggtgatcagcagcttcctgataagatctcaggaggtgggtgagtgggctcaagcatgagcactaagagttaaattgacggagttttttttttttgttttttttgagagggagtctcgctctgtcacccaggctggagtgcagtggtgtgatctgggctcacggcaacccccgcctcccaggttcgagcaattctcttgcctcagcctccagagtggctgggactataggaaaccgccaccatgtctggctaattttttttttttttttttttttttttttgagacggagtctcgctctattgccaggctagggtgcaatggcttgatctctgctcactgcaacctccgactccctggttcaagctattctcctgcctcagcctcctgagtagctgggattataggcacacaccactgcgcctggctaatttttgtattttttagtagagacggggtttcaccatgttggccaggatggtcgcgatctcctgacctcgtgatccacccacctctgcctcccaaagtgctgggattacaggagtgagccactgcgcctggcctatttttttatttattatgtatttatttatttaaaaaaatttttttttgagacagagtctcgctctgtcgcccaggctggagtgcagtggtgtgatctcagctcactgcaagctccgcctcccaggtttacgccattctcctgcctcagcctcccgagtagctgggactacaggcacctgccaccacgcctggctagttttttgtatttttagtagagaaggggtttcaccatgttagccaggagggtctcgatctcctgacctcgtgatctgcccacttcggcctcccaaagtgctgggattacaggcgtgagccaccgtgcctggccaattttttttttatttttagtagagacagggtttcaccatgttgggcaggctggtcttgaactcctgatctcaggtgatccacctgcctcggcctcccaaagtgctgggattataggcgtgagccactacacctagccaaaatggcaaagttcaactggcatatgatctttctctgggaacacttgattggtaagggaagaatgctcaagtgaacatgtgtttagctccagtaaacacactacacatgcggccctcccaagtgctagcaggccactacacatgcagacagccaccccaaaggaagaatcaggggcaaggtccccagaagcatgccaaggtataaaatcccaagtcaaaggtcaaaccatgcacttggatctctcaagtcacccgcttggccctcttccaagtgtacttccttttgtttctgctctgaaacttttttatttattttttatttatttattttttttgagatggagtctcgctctgttgcccaggctggagtacagtggcatgatctcggctcagggcaagctccacctcctgggttcacgccattctcctgcatcagcctctggagtagctgggactacaggtgcccgccaccatgcccagctaatttttttgtctttttagtagagacggggtttcactgtgttagccaggatggtctctatctcctgacctcgtgatccacccacctcggcctcccaaagtgctgggattacaggcgtgagcctctgcgcccggtctctgctctgaaacttaaactttcactcctatgctaaaacttgcctcagtttctccctctgccttacgcccgttggtggaactctttctgaggaggcaagaattgaggttgctgcagacctgtacagattagccgttgctaacaaaacgattttg

SEQ ID NO: 325 - DNA, 2143 bp, Homo sapiens
tacaacagaaattccctataattcccaaggacaggccatagttgaaagaactaatagaacactcaaaactcaattagttaaacagaaagaaggggaagacagtaaggagtgtaccactcctcagatgcaacttaatctagccctctatactttaaattttttaaacatttatagaaatcagactactacttctgcagaacaacatcttactaaaaagaagagcccatatgaaggaaaactgatttggtggaaagacaacaaaaataagacatgggaaatagggaaggtggtaacgtaagggagaggttttgcttgtgtttcaccaggagaaaatcagcttcctgtttggatacccactagacatttgaagttctacaatgaacccattggagatgcaaagaaaagcgcctccacggagacggagacactgcaatcaagcaccatcaactcacaagatgaacagaatggtgatgtcagaagaacagatgaagttgccatccaccaagaaggtggaggcgccgacttgggcacaattaaagaagctgacacagttaactaaaaaaaaaaaagcctagagaacacaaaggtgacacaaactccagagaacatgctgcttgcagctttgatgattgtatcaactgtggtaagtctccccatgcctgcaggagcagctgcagctaattatacctactgggcctatgtgcctttcccgcccttaattcaggcagtcacatggatggataatcctgatgggagataggctcatgagcctagaacatcgtttccagttacagtgtgactgggatacatcagatttttgtattacaccccgagtttataatgagtctgagcatcactgggacatggttagacgccatctgcagggaagagaagataatcccactttagacatttccaaattaaaagaacaaattttcgaagcatcaaaagcccatttaaatttggtaccaggaactgaggtaatcgcgggagttgctgatggcctcacaaatcttaaccctgtcacgtgggttaagaccatcggaagtactactattgtaaatttcatattaatccttccccagaggcaggccccagtctgcaggtgtacccagcagctccgaagagacagcgaccatcgagaacaagccatgatgacaatggtgtttttgtctaaaagaaaaggggaaaatgttgggaaaagaaagagagatcagactgttactgtgtctatgtagaaagaggtagacataacagactccattttgttctgtactaagaaaaattcttctgccttgagatgctgttaatctgtaaccctacccccaaccctgtgctcacagaaacatgtgctgtgtcgactcaaggtttaatggatttagggctatgcaggatgcactttgttaaacaaatgcttgaaggcagcatgcttgttaaaagtcatcaccactccctaatctcaagtacccagggacacaaaacactgcagaaggccacagtgacctctgcctaggaaagccaggtattgtccaagggttctccccatgtgatagtctgaaatatggcctcgtgggaagggaaagacctgagcgtcccccagcccgacacctgtaaagggtctgtgctgaggaggattagtaaaagaggaaggcctctttgcagttgagataagaggaagacatctgtctcctgctcctccctgggcaatggaatgtctcggtgtaaaacccgattgtatgttccatctactgagataggagaaaaccgccttaaggctggaggtgagacatgctggtggcaatactgctctttaatgcattgagatgtttatgtatgtgcacatcaaagctcagcacctttttcttaaccttatttatgatacagagacatttgttcacatgttttcctgctgaccctctccccactattaccctactgtcctgccacaaccccctctcagagatggtagagataatgatcaataaatactgagggaactcagagacccgtgccttcgcgggtcctctggagcaccagtcccctgggcccacttttccttctctatactttgtttctgtgtctctctcttttgtcagtccgatgagaaacacccacaggtgtggaggggcaggccaccccttca

SEQ ID NO: 326 - DNA, 983 bp, Homo sapiens
gtagggaaaagagagatcagactgttactgtgtctatgtagaaagggaagacaaaagaaactccattttgacctgtaccctgaacaattgctttgccttgagatgctgttaatctgtaactttgccccaatcttgagctcacagaaacatgtgttgtatggaatcaaggtttaagggatctagggctgtgcaagatgtgccttgttaacaaaatgtttacaggcaggcagtatgcttggtaaaagtcatcaccattctccagtctcgataaaccaggggcacaatgcactgcggaaagccgcagggacctctgccctggaaagccaggtattgtccaaggtttctccccatgtgatagtctgaaatatggccccgtgagatgggaaagacctgaccgtcccccagcccgacacccgtagggggtctgtgctgaggaggattagtaaaagaggaaagcctcttgcagtggagatacaggaaggccactgtctcctgcctgcccctgggaactgaatgtctcggtataaaacccaattgtacatttgtttaattctgggataggagaaaagccaccctgtggtgggaggtgagacatgttggcagcaatgctgctctgttactctttactctactgagatgtttgggtggagaaaagcataaatctggcctacgtgcacatctaggcatagtaccttcccttgaacttatttgtgacacagattcctttgctcacatgttttcttgctgaccttctccccactatcaccctgctgtcctgccacattgctcttgctgagacagtgaaaacagtaattaataaatactgagggaactcagagactggtgctggtgaaggtcctccgtatgctgagcgccggtcccctgggcccacttttctttctatatactttgtctctgtgtcttatttcttttctcagtctcttgtccagactgactagaaatacccacaggtgtggaggggc

SEQ ID NO: 327 - DNA, 7718 bp, Homo sapiens
gtaggagattggtcagggtggtgggaaaagttataaggagagacgcaaaccttcttggaagtcctgggaggttttgcaaagcttcgggagagaataaaggctgaaggcagctaaattctcttaccctgaggctaagggcaagtagtaggtaacaaaggagtgtaaaggaatttatctagataagtttatttacttttgccgacctttgatcatccgacctttgatcatccgacctttgatcatctgacctttgatcatctgacctttgatcatccgacctttgatcatctgacctttgatcatccgcgtgcaggactgctccctacaggcgggggcaacaactacccacagattgtgttggctccaggcctttgtcattaaatctgtactaaataaatacaagcagctccagcttattggggctgcgttctctcttcggcgtctctaaggccgagcagtttcctagctgcgctcacgcaaaatacctgtgtctgcgtacttttttcatccgtcgctcggccagagtcggtggatcagactcagcagctggtgcccctcgtgaggaacactgcaagggatcacgacggaacccccgaaaatgaaggcgaagagactgtgcagtcagtaagtcattggtgcccactcgggatatccaagttcaggggaattctcagactagagtttcatcatgagacaacagctgtccgcacaacagaaacagtatataaaagtattgaaacaactgcttaaagctagcagagcctcggtttcacaggctcagttaagggtcctaaggcaaactgttgtttcccataatccatggttcccagcagaaggcatgctggacctagagctctgggaataagtggggagaaatcttaaacaataccataaacaagggcaacgggtcccagtaacatctttaaccttatgggccttagttagggctgctttggccctgctgtacacagaagatcccaagaagggaagggagaaggaaccatcacctaccttaccgccgcctcctcttccctcagccctgccattactgggtaaagataccaaagaggaaacagaggttttccctgagccccctcccccaataaattggaaaaaagacaagggatacactacagctgtgggaccctgtcttaggcaagtggcattagaaggggagctcttaacctgcccggtaatgcaagatcagcaaggtactcaggtatatgaacccatttcttttgacgcttataaagataagaaaaagcatcagagcaaacggagctgctagtccatttatgaaaggattaattgaagccatagcagacaacttctgtttggccccatgggactggtcagtgctagctaaaacaactttagagcccagtcagtacctcctctggaagacagagtatgatgagttgtatgaacaacaagccaaccagaatcaattggccgggcaaaacataacagctgctatgcttcaggggaggggttcctatgccagtgtccaacaacaattaagttttgttccctaagcctatgcacaagtgtctttgtgtgctatgagggcttgggactgaattcccgaattccgaaagcggaagttcaacaaggatctttataaatgttcgacaagggcctcaggagccattttttgaatttatcaatcggttaacccaggcaattaagagacaaattagtcatccccaggccgctgataatcttattgttgcagttggcttatgaaaatgctaacgtcgactgccaacaagcaatgcaggcagtcagaggaaaggcagttacggccagggaacttacacgagcacgtcaactggtggggactgaaacacacaaagccaaaatattggccatggcaataaagtctcctgaagtgaaaagggagaaaaccccaaattgttttctgtgtggagagccaggtcataagaagaggcagtgccccactagtagagaccaaggtaactcagcaaaagaacccccttctatatgcccccgacgtagaaaggggaaacgttgggcaaatcagtgcaagtccaaatttgataaagatgccaaccacctaagtaatcaggtgggaaacttcatgaggggccagccccaggccctgctccaaacttgggcaatgccagcggctttcctcggtcaattggaaagcccacagtccactctctcagaacagccacctctgggagcgcaggattgggcttactctgccccaacgaattagtgctaaaaggagaagaccctaaaaggattgcaacagggatctggggcccactgcctccagaacagtgggattggtcctaggatgatcaagcctatccagcaaaggaattaatgtgctcaccagggtaattgatagtgattatcaagattgaggtattagttatgatggagtgtaaaggtctgcatattcttccccctaaatctaaaatagctcagttactattcttaccgtactgggtccccaatgcccagggaaagaggaagggaagttttggaagcacgggagccgtaggagtgtattggaaccagttaatcactgatcagagacccatgattaccttaaaaatcggaaataagaattttactggcttataggatacaggggtgaatatttcgattattagttatcaaaactggtcagaaacttggccttgggtcactcagaaacaaaaaattgtcagcactggctaagtgcacacagccaagcagagcacacaccccctaacgttgtgatttggagggaaaaaacagttagcaactctaaacatgactgtccctgttaacctttggggacgggaccgattagcccaatgggggctgcaaacccctttctaataatggccactgttgttattcttcccctacccctgacgtggttctctcaagatccaatttgggtagcacagtggcctttaaagggagggaaataacagtgagcccatgagttagttcagcaattaaaagccagccatatagaaccatcaagcagcccttagaatttgcccattttcatcattcccaaaaggtctgggaaatggggacttgcatgacttacgggctatcagtggcagtttgcaacctatggggccccttcaacggggctcccttcccctgtggcaattcttcaagataggcctatagtcgatattgacttaaaagactgctttaatactattccccttgcagaacagggcagagaacaatttacatttaccatactagctatcagtaatgaaagggcagcttgccaatttcattggaaagtacttcctcaaggaatgctgaacagtcctaccatgtgtcagcatcatgtaaatcaggctttgctccccagtagaaaaaaatttcctaattgcaagattattcattttgtagatgatattttactagcagacccaacagagccaatacttttgagtttatatgcctctgtcgttaagatgttaatcatagcacctgaaaaagtacagatgtcctcaccttggaaatatcttaggtacatactaacttcctggtcagtaagacctcaaaaggttaaattaaatactagcaacttacataccttaaatgattatcaaaaattactgggtgatattaactggcatccccccaccttgggcataactactgataaattacagaacctgttttctatcctaaaaggcagtgctgccctagactcacccaggtatttaacccccgcagcaaaaagggaaattgaggaaatagaccaagttatttctcagagacaactagatagcatagatccacgatattcagttcagttgtttgtttttcctgctaaacactcctctacaggattaataggacagatggccacagggctgcgcttcctagaatgtgttttttgctcacatactgggactaaaacactatttggctatatccagctagttagtaaagtcatctatatgggctgcagacgatgcaatctgtggctgggttatgaccctgaatgtcataagaattttcttgagtagaaattcgaagtagtcttgctccatctctagattttcaattagcactctttgattatgcaggccatataaaatatgcccttcctgctggcagactatttcagttcttatctcatactcctctagttttgccaacaaaagtagttcactccctcatacctaaagctttaacgctttttactgatggctctggtaaaaatggaaaagcggctatttggtggaaaccacataattccctcactcaatctggatttactaccgctcagggagctgaggttggagccctagtactggccctagaaaccgaatccgttcagcccattaacattgttagtgactctgtttgtttgttgcaaaaccttgagaccgccctcattaagtccactctcgagcctaccctgtgtacaccttttcttggacttcagcaattgctgggtcaacatacacagttttatcacacatattcgagcacacagctcactgccttgcccactggcttatggcagtgatcaagcagacctgcagcttatgacgtcactgcttgaccaagccacccagtcgcttcagtttttccaccaaaattagagaaacttaacaatagcagcttacccaaagactgggtaaacaaattatcctgcagtgcccagattgccagctcacaggcacatctcttccttgaacaggtgttaaccttagaggactagaaccttatccattatagcaacagatgttacacacgtccctaaatttggaatactaagatatgtacatgtatccattgataccagttcctacctaattagcgcacatgctcttcctggagagtccacacgatacatcattaaacatcttttaacttttgcgtttatggggtggcccacaaaaattaaaactgataataatctggcctgtgccagctcacatattcaacaattttgtcacacatggagcatccaacattccacaggcatcccgtataactgacaggccatagtagaacgtgcccactccacccttaaaaatatgctcagaaaacaaaaaggggaaaatgagtaaggaccctgcaacactactagcacaagtgttatttacccttaatttctaaaatttaaatgataaatttcaatcaactatagaaaagcaccttgctaaaacctctcaagacataaaacccgcagttttatggaaagatgtaaatagtaacgtatggtgtagtccaaatgaattgctaacgtggggaagatgatatgcttgtgttcacacccccctcaggccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgtaagttacaactcacgtaggatcctttttatgctctcgcttcccctgcaacccgtaccggctacactctattgggctcatctgttagatccgcctttcttacgccctgttacctgggcaggcacccccttcccagcctctaataacgttaactgcttggctaggagggattgacttatcccagtagggtccgttattaatggcacacattggactaaggtgccaggtaacactacatatcactccattatcttcccactgtgtgtaaggttactatgtacctgccgaaacacaattatggctacaaatggcaaaggaattgccttaacattcttgtgccagtagcctcaaaccgggcaaggcaatcagtgccactttccccagcattcttccctgtgctaaagaacaaagccaggaaagtaatggattccactttggttgggaggtctgtcacgggggacaagcccttagtctccagttaggcaatttaacatcttagactggagcccccacggtcatttacagggcgaccatactgatgtttgcatccattgtggtgtcaatcttagtttcatagccatgtccgttcccctgtgatttgggccaaaggggggatgggatatcccagaccccaagtagagtccttgccaccccaagacacttaatggcatctgggacatcttagcaccacccttaacacctggcatgggacataacataattccagtaacaattatactatgacctttatgcataatcacacagatcagtgcctgatttgcactacccatccatatgtttttcttatgggaaccagtatttccattacacctcaaaactccatgtttgtgacctgagtgcaaggacaggcttgcttcacctcatgtatcattaattacaatatatctaatttaaatattactagtattatggtattaaggagacaatctgaggcattcctaccagtcagtttgatacacgattggcaaggttcctttgctcttgccaccttagaacatgccctgtcccaggtcagacaccaaagattcatagttaatcttacagcctttatagtctcagccatagtcatcctagcaactgctagttttgctgtagcatctattactgaatcagtacaaatagctgcttttgtagataacttggccagaaatgtgtctaatgaacttctcttacagcagggtacaaatcaaaaggttcttgcacatctgcaagccctcgaggctgccttggaacatgtaggggagtgacaagatgcgctggcattctgacagcaattaaactgtgactgggagcataagcatatctgtgtcacctctctaccatggaaccaatcaatacatagttgggatgaggtgaaacaacacctcggggtgaccttacatgataatttaacagcagacgtaaagcaacttaaaactaaaattctagaatccctaaacgccatagatctacatgtccaacaaacagttatatggaaggatgtgcaagaacatctctcctggatagaccctcactccttgattggaaaaaaatattactaattatactcatgtttgtcttatgttatttactaattctaggatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgcaaaatacctgtgtctgtgtacttttttcatccgtcgctcagcctgagtctgcaggtcagacttggca

SEQ ID NO: 328 - DNA, 6332 bp, Homo sapiens
gtcaggcctcggagcccaagctaagccatcatatcccctatgacctgcatgtatacatccagatggcctgaagtaactgaagaatcacaaaagaagtgaaaatggcctgttcctgccttaactgatgacattaccttgtgaaattccttctcctggctcatcctggctcaaaagctttcccactgagcaccttgtgtcccccacccctgccagccagagaacaaccccctttgactgtaattttcctttaccttcccaaatcctataaaatggtcccaccccatctccctttgctgactctcttttcagactcagcccgcctgcacccaggtgaaataaacagccttgttgctcacacaaaacccgtttggtggtctcttcacacggacgcgaatgaaatttggtgctgtgactcggatcgggggatctcccttgggagataaatcccatgtcctcctgctctttgctctgtgagaaggatccacttatgacctcaggtcctcagaccaaccagcccacagaacatctcaccaattttaaatcgggtaagcggcctctttttactctcttctccaacctctctcactatccctcaacctctttctccttcagtctttcccttctcttaatttcagttccttcaatcacactttggtctctcccttctcttaatttcagttcctctccttttctggtagagacaggagatgcgttttatccgtgaacccaaaactccggcgctggtcacggactcgggaagacagtcttcccttggtgtttaatcatgtggggttgcctgcttgattattcacccacatttcagaggtgtctgaccacacagggatgcctgccttggtccttcagccttagcggcaagcactgcttttctggggggcaagcacccccccaccccttctctccatgtctctatcccttttccactttcctggagggcaagcatcccccacctcttctctccgtgtctttaccccttttccacttttctggggggcaagcacccccccactccttctctctctgtctctaccccttttccactttcctggggggcaagcacctcccaccccttttctgctttcctaagggcaagcgccccccaccccttctctccatgtccctatcctctcttttctctggacttgcctccttcactataggcaaccttccacactccattcctccttcttctcccttagcctgtgttctcaagaacttcaaacctcttcaactcacacctgacctaaaacctaaatgccttattttcttctgcaacaccgcttgaccccaatacaaacttgacagtggttccaaataaccagaaaacagcactttcgatttttccatcctacaagatctaaataattcttgtcataaaatgggcaaacggtctgaggtgcctgatatccaggcattcttttacacatcggtccctccctagtctctgtttctaatgcaactcgtcccaaatcttgcttctttccctcccgcctgtcccctcagtcctaaccccaagcgtcaatgagtctttccaatcttccttttctacagacccatctgacctctcccctcctccccaggctgctcctcgccaggctgagctaggtcccaattcttcctcagcctccactcccccaccctgtaatccttttatcacctcctctcctcacacccagtccagcttacagttttgttctgcaactagccctccccaacctgcccagaaatttcctcttagaaaggtggctggagctaaaggcatagtcaaggttaatgctcctttcctttatctgacctttcccaaatcggttagtgtttaggctctttttcatcaaatataaaaacccagcccagttcatggcctgtttggcagcaacccttagactctttacagccctagacactgaagggtcagaaggctgtttcattctaaatatgcattttatcacccagtcagctcctgtcattagaaataaagctccaagaattaaattccggccctcaaaccccaaaacaggacttaattaacctcaccttcaaggtgtacaataatagagtagaggcagccaagtagcaatgtatttctgagttgcaattccttgcctccactgtgagggaaaccccagccacatctccagcacacaaaaacttcaaaacgcctgaaccgcagcagccacgtgttcctccaggacctcctcccccaggagcttgctacaagtgctggaaatctggccactgggccaaggaatgcccacagcccgttattcctccttagccatgtcccatctgtgtgggaccccactgaaaatcggactcttcaactcacctggcagccactcccagagcccctggaactctggcccaaggctctctgactccttcccggatcttcttggcttagcggctgaagactgatgctgcccaatcaccttggaagccccctagaccatcatggatgccaagcttcgggtaactctcacagtggaaggtaagcccgtccccttcttaatcaacacggaggctacccactccacattaccttcttttcatgggcctatttcccttgcccccataactgttgtgggtattgatggccaggcttctaaacctcttaaactccccaactctggtgccaacttggacaacattcttttatgcactcttttttagttatccccacctgcccagttcccttattaggctgagacattttaactaaattatctgcttccctgactattcctaggctacagccacacctcattgctgccttttcccccagttcaaagcctccttcgtgtcttcctttcgtatctccccaccttaacccacaattataggatacctctactccctccatggcaaccgatctcaagcccttaccatcccattaaaacctaatcacccttaccccgctcaacgccaatatcccatcccatagcacactttaaaaggattaaagcctgttatcacttgcctgttacagcatggccttttaaagcctataaactctccttacaattcccccattttacctgtccaaaaaccggacaagccttacaggttagttcaggatgcacactttatcaaccaaattgttttgcctatccaccctgtagtgcccaacccttacactcttttgtcctcaataccttcctccacaactctctattctattcttgatcttaaagatgcttttttcactattcccctgcaccccttgtcccagcctctctttgcttttacctagactgatcctgacacctatcagtctcagcagcttacctgggctgtactgccacaaggctccagggacagccctcattacttcagccaagctctttctcatgatttactttctttccatccctccgctgctcaccttattcaatatattgatgaccttctactttgtagcccctcctttgaatcttctcaacaagacatcctcctgctctttcaacatttattctccaaaggatatcgggtatccttctccaaagctcaaatttcttctccatccgttacctaccttggcataattcttcataaaaacacacatgctctccctgctgatcgtgtctgactgatctctcaaaccctaacaccttctacaaaaccacaattcctttccttcctaggcatgattggatactttcacctttggatacctggttttgccatcctaacaaaaccattatataaactcacaaaaggaaacctagctgaccccataaatcctaaatcctttccccactcctcttttcattccttgaagatagctttagagactgcccccacgttagctctccctgactcatcccaacccttttcattacacacagccaaagtgcagggctgtgcagttggaattcttacacaaggaccaggaccatgccctatagcctttttgtccaaacaacttgaccttactgttttaggctggccatcatgtctctgtgcagtggctgccaccgccctaatacttttagaggccctcaaaatcacaaactatgctcaactcactctctacagttctcataacttccaaaatctattttcttcctcacacctgatgcatatactttctgctgcactacactacctctcagcaagccaaactcattgccttaactcaagtcctcacccttgcaaaggaattatgtgtcaatatttatactgactctaaatatgccttccatatcctgcaccaccatgctgttacatgagctgaaagagatttcctcactatgcaagggtcctccattattaatgcctctttaacaaaaactcttctcaaagctgctttacttccaaaggaggctggagtcattcactgcaagggccatcaaaaggcatcagatcccattgctcaggacaatgcgtatgttgataaggtagcttaaaaagcagccatcaaaaggcatcagatcccattgctcaggatgatgcttatgctgataaggtagctaaaaaagcagctagagttccaacttctatccctcatggcagtttttctccttttcatctggccactcccacctactccccaactgaaacttccacctatcaatcttttcccacacaaggcaaatggttcttggaccaagggtctccttccagcctcacaggcccattctattctgttgtcatttcataacctcttccatgtaggttacaagccgctagcccatctcttagaacctctcatttcctttccatcgtagaaatctatcctcaaggaaatcacttctcagtgttccatctgctattctactactcttcagggattactcaggcctacatatcaagctcggggccacccaggactggaaaattgactttactcacatgcctcagtgaggaaactaaaatacctcttggtctgggtagacactttcactgggtgggtagaggcctttcccacagggtctgagaaggccaccgcagtcatttcttcccttctgtcagacataattcctcggtttggccttctcacctctatgcagtccgataacggactggcctttattagtcaaatcacccaagcagtttttcaggctcttggtattcagtgaaatctttatatcccttaccgtcctcagtcttcaggaagggtagaatggactaatggtcttttaaaaacacaactcaccaagctcagccaccaacttaaaaaggactggacaatacttttatcacttgcctttctcagaatttgggcctgtccttggaatgctacagggtacagcccatttgagctcctgtatagacgttcctttttattaggccccagtctcattccagacaccataccaacttggactgtaccccaaaaaacttgtcatccctactatcttctgtctggtcatactcatattcaccattctcaactacacataaatgccctgctcttgtttacagtgccggtttacactgtttctccaagccatcacagctgatatctcctggtgctatctccaaaccgccactcttaactccttcttaaagtaaataaataatctttgctggcagggctatgctgaacctccttgggcactctctaattagatgtactgggtcctcccaattcttagtcctttaatacctgtttttctccttctcttattccttttagttttttaattcatgcaaaaccatatccaggccatcaccaatacttctatacaacaaatgtttcttctaacaaccccacaatatcaccccttaccacaaaatcttccttcagcttaatctctcccactctagattcccacgctgcccctaatcccgcttgaagcagccctgagaaacatcacccattctctctccataccaccccccaaaattttcaccgccccaacactttaccactattttgttttatttttcttattaatataaaaagacaggaatgtcagacctctgagcccaagctaagccatcatatcccctgtgacctgcacatacatccagatggcctgaagtaactgaagaatcataaaagaagtgaaaatggcctgttcctgccttaactgatgacattaccttgtgaaattccttctcctggctcatcctggatcaaaagctcccacactgagcaccttgtgacccctacccctgccagctagaaaacaaccccctttgactgtaattttcctttacctacccaaatcctataaaatggccccacccctatctccctttgctgactctcttttcagactcagcccatctgcacccaggtgaaataaacagccctgttgctcacacaaaacctgttgggtggtctcttcacacggatgcgagtgaaa

SEQ ID NO: 329 - DNA, 971 bp, Homo sapiens
ggaggggatgtggggaaaagcaagagagatcagattgtcactgtgtctgtgtagaaagaaatagacatgggagactccattttgttatgtactaagaaaaattcttctgccttgagattctgtgaccttacccccaaccccgtgctctctgaaacatgtgctgtgtcaaactcagggttaaatggattaagggcagtgcaagatgtgctttgttaaacagatgcttgaaggcagcatgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgactgtccccccgcccgacaccccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtatgttccatctactgagatagggaaaaaccaccttagggctggaggtgggacatgcgggcagcaatactgctttgtaaagcattgagatgtttatgtgtatgcatatctaaaagcacagcacttaatcctttaccttgtctatgatgcaaagacctttgttcacgtgtttgtcggctgaccctctccccacaattgtcttgtgaccctgacacatccccctcttggagaaacacccacgaatgatgaataaatactaagggaactcagaggctggggggatcctccatatgctgaacgctggttccccgggtccccttatttctttctctatactttgtgtctttttctttcctaagtctcttgttccaccttatgagaaacacccacaggtgtggaggggcaacccacccctaca

SEQ ID NO: 330 - DNA, 6139 bp, Homo sapiens
gtcaggcctctgagcctaagctaagccatcatatcccccgtaacctgcatgtacacatccagatggccagttcctgccttaactgatgacattccaccacaaaagaagtgaaaatggcctgttcctggcttaatggatgacattatcttgtgaaattccttctcctggctcatcctggctcaaaagctcccctactgagcaccttgtgacccccactcctgcccaccagagaacaacccctttgactataattttcctttacctacccaaatcttataaaacggccccaacccatctcccttcgctgactctcttttcggactcagcccgcctgcacccaggtgaaatgaacagctttattgctcacacaaagcctgtttggtggtctcttcacacggacgtgcatgaaatttggtgccatgactcggatcgggggacctcccctgggagatcaatcccctgtcctcctgctctttgctccatgagaaagatccacctacgacctcaggtcctcagaccaccagcccaagaaacatctcaccaatttcaaatccagtaagcggcctctttttactctcttctccaacctccctctatccctcaacctctttctcctttcaatctgggcgccacacttcaatctgtcccttctcttaatttcaattcctttcattttctggtagagacaaaggagacacattttatccatggacccaaaactccggcgctggtcacggactaggaaggcagccttcccttggtgtttaatcactgcagggatgcttctctgattattcacccacgtttcagaggtgtcagaccacgcagggacgcctgccttggtccttcacccttagcggcaagtcccgcttttctgggggacttgccaaccccttctctccatgtctctaccccttctctgcttttatgggggaagggcaagaactcctcaaccccttctccttcacccttagtggcaagtcccgcttttctaaggggcaagaacccccaatcccttatccctgcatcctgacctcttatctctgtgccccaatcccttatcactgtgccccaatgccttatttccgtgccccaacctcttatctccatgccctgaccccttatttccatgccccgacccctttcccacttttctggagggtaagaacccccgaaccccttccctccatgtctctactctctcttttctctgggcttgcctccttcactataggcaaccttccacccttcattcctccttcttctcccttagcctgtgttctcaagaacttaaaacctcttcaactcacacctgacctaaaacctaaatgccttattttcttctgcaacaccggttggccccaatacaaacttgacaatggctctaaatggccagaaaacggcactttcaatttctccatcctacaggacctaaataatttttgtcgaaaaatgggcaaatggtctgaggtgccttaagtccaggcatttttcacacttcattccctccctagtctctgttcccaattcgattcctcccaaatcctccttttttccctcccacctgtcccctcagtcccaaccccaagcattgctgagtctttccagtcttccttttctacagacccatctgacctctcccctcctcctcaggctgctcttcaccaagctgagctaagtcccaattcttcctcagcctccgctcctccacctataatacttctaccacctcccctcctcacacccggtctggcttacagtttagttccatgactagctcttccccacctgcccagcaatttcctcttagagaggtgcctggagctgaaggcatagtcaaggtacatgtacctttttctctatcagaccgctctcagatcagtcaatgtttaggctctttctcatcagaccccactaaatacatacaggaattctgatatctaactctgtcctacaatttaacctggagtgacttaaatgtcatcctgacttctaccctctccccagatgaacgggaaagagttttttctctagcccaatctcatgctgacaaccgctggcttcatgagccagacctccaggaaggcattagagcagttccccgagaggatccccaatggaactaccaggcaaattccccaggtatagctaggcgagattacatgatttcctgcctagttgaagggcttaaaaaggcagcttacaaagctgttaattatgacgagcttaaagaaactacccaaggtaaagacgaaaacccagcccggttcatggcccgcttagcagcaacacttagacactttactgccctagacccagaggggccagaaggccgccttattcttaatatgcattttatcacccaatccactcctgaaattaggaaaaaactccaaaaattaaattccggccctcaaactccacaacaggacttaattaaccttgccttcaaggtgtacaataatagaaaaaagttgcaattccttgcctccactgtgaggcaaaccccagccatatctccagcacacaagaacttccaaacgcctgaactgcagcggccaggcattctccagaacctcctcccccaggagcttgctacaagtgccaaaaatctggccaccaggccaaggaatgcccgcagcccacctgaactgcagcggccaggcgttcctccagaacctcctaccccaggagcttgctacaagtgccaaaaatctggccaccaggccaaggaatgcccgcagcccgagattcctcctaagccatgtcccatctgtgcaggactccactggaaattggactgttcaactcacctggcagccactcccagagcccctggaactctggcccaaggctctctgactgactccttcccagatcttctcggcttagcggctgaagactgacgccgcccggtcacctcggaagccccgtagaccatcacagatgccgagctttaagtaactctcacagtggaaggtaagtccgtccccttcttaatcaatacagaggctgcccactccacattaccttcttttcaaaggcctatttcccttgcctccataactgttgtaggtattgacggctaggcttctaaacctcttaaaactccccaactctggtgccaacttagacaatactcttttaagcactcctttttagttatccccacctgcccagttcccttattaggccgagacgctttaactaaattatctgcttccctgactattcctggactacagctacatctcattgccgcccttcttcccaatccaaagcctcctttgcgtcctcctcttgtatcccccaccttaacccacaagtataagatacctctactccctccttggcgactgatcacgcaccccttaccatctcattaaaacctaatcacccttaccccactcaatgccaagatcccatcccacagcatgctttgaaaggattaaagcctgttatcactcgcctgctacagcatggccttttaaagcctataaattctccttacaattcccccattttacctgtcctagaaccagacaagccttacagtttagttcaagatctgtgccttatcaaccaaatggttttgcctatccaccccatggtgccaaacccatatactctcctatcctcaatacctccctccacaacccattattctgttttagatctcaaacatgctttctttactattcctttgcacccttcatcccagcctctgttcactttcacttggactgaccctgacactcatcaagctcagcaaattacctgggctgtactgccgcacgtcttcacagacagcccccattacttcagtcaagcccaaatttcttcctcatctgttacctatctctgcgtaattctcataaaaacacacttgctctccctgccgatcatgtccagctgatctctcaaacccctacaccttctacaaaacaacaactcctttccttcctaggcatggttagtgtggtcagaattcttacacaagagccgggactgcaccctgtagcctttttgtccaaacaacttgaccttactgttttaggctggccatcatgtctccatgcagcagctgctgccgccctaatacttttagaggccctcaaaatcacaaactatgctcaactcactctctacagctctcataatttccaaaatctattttcttcctcacacctgatgcatgtactttctgctccccagctccttcagctatactcactctttgttaagtctcccacaattaccattgttcctggcccggacttcaatctggcctcccacattatttcagataccacacctgaccctcatgactgcatctctctgatccacctgatgttcatcccatttccccatgtttccttctttcctgttcctcaccctgatcacacttagtttattgatggcagttccaccaggcctaatcgccacacaccagcaaaggcagcctatgatatagtacgagccactagcccacctcttaaaacctctcatttcctttccattgtagaaatctatcctcaaggaaataacttctcagtgttccccctgctattctactacttctcagggattattcaggccccctcccttccctatacatcaagctcgaggatttgcccccacccaggactggcaaattagctttactcaacatgcccgagtcagataactaaaatacctcttaatctaagtagacactttcactggatagatataggcctttcctatagggtctgagaaggccttctcagtcatttcttcccttctgtcagacataattcctcagtttagccttcccacctctatacagtttgataacagaccagcctttattagtcaaatcagccaagcagtttttcaggctcttagtattcagtgaaacctttatatccctaacagtcctcagtcttcaggaaaagtagaacggactaaaggtcttttaaaaacacacttcgccaagctcagccaccaacttaaaaagtactggagaatacttttaccactttcccttctcagaagtcaggcctgtcctcagaatactacaaggtacaacccatttgagctcctgtatggacactcctttttattaggccccagtctcattccagacaccagaccaacttggactgcaccccaaaaaacttgtcatccctactatcttctgtctagtcatactcctattcaccattctcaactactcatacacgccctgctcttgtttacactgccagtttacactatttctccaagccatcacagctgatacctcctggtgctatccccaaactgccactcttaactcttaaagtaaataaataatctttgctggcaggactatgctgaatcctcttaggcactctctaattagatgtcctaagtcctcccaattcttagtcctttaatacctgtatttctccttctcttattccgtttagtttttcaatccatacaaaaccatatccaggccatcactaataattctacacgacaaatctttcttccaacaaccccacatcaccccttaccacaaaatcttccttcagcttaatccctcccactctaggctcccacgccgcctgtaatcccgctcaaagcagccctgagaaacatcacccattatctctccatactaccaccaaaaattttcaccaccccaacactttaccactatttcattttatttttcttattaatataagaagacaggaatgtcaggcctctgagcctaagctaagccatcatatcccctgtgatctgcatgtacacatccagatggccagttcctgccttaactgatgacattccaccacaaaagaagtgaaaatggcctgttcctgccttaactgatgacattatcttgtgaaattccttctcctggctcatcctggctcaaaagctcccctactgagcaccttgtgaccccaactcctgcccgccagagaacaacccctttgactataattttcctttacctacccaaatcctataaaacggccccacccatatctcccttcactgactctcttttcggactcagcccgcctgcacccaagtgaaataaacagctttattgctcacacaaagcctgtttggtggtctcttcacacggatgcgcatgaaa

SEQ ID NO: 331 - DNA, 970 bp, Homo sapiens; identical to SEQ ID NO: 108

SEQ ID NO: 332 - DNA, 966 bp, Homo sapiens
gcagggaaaaggaagagagatcagattgttactgtgtctgtgtagaaagaagtagacataggagactccattttgttctgtactaagaaaaattcttctgccttgagatgctgttaatctataaccttacccccaaccccgtgctctctgaaacatgtgctgtgtcaactcagggttaaatggattaagggctgtgtgggatgtgctttgttaaacagatgcttgaaggcagcatgctcgttaagagtcatcaccattccctaatctcaagtacccagggacacaaacactgcagaaggccgcagggacctctgcctaggaaagccaggtattgtccaaggtttctccccatgtgatagtctgaaatatggcctcatgggaagggaaggacctgaccatcccccagcccgacacctctaaagggtctgtgctgaggaggattagtataagaggaaggcatgcctctttgcagttgagacaagaggaaggcatctgtctcctgcccgtccctgggcaatggaatgtctcggtataaaacccgattgtatgttccatctactgagataggggaaaaccaccttagggctggaggtgggacatgcgggcaacaacactgctctgtaaggcattgagatgtttatgtgtatgcatatctaaagcacagcacttaattctttaccttgtctatgatgcagagacccttgttcacgtttatctgctgaccttctctccactattatcctatgaccctgccacatccccctctccgagaaacacccaagaatgatcaataaatactaagggaactcagaggctggcgggatcctccgtatgctgaacgctggtaccctgggcccccttatttctttctctatactttgtctctgtgtctttttcttttccaaagtctctcgttccacctaacaagaaacacccacaggtgtggaggggcaacccaccccttca

SEQ ID NO: 333 - DNA, 680 bp, Homo sapiens
ttagagtaggtagttaggcagacatgagccaggcaggagagcctctcccaaccccagagaacttcaggggaccatcaggtaatggtcaggtggttgttaaactgtgtctctgaaattataattggtcacagctggtactagggaccgacagtctcccaataaataggaaactcctggagctgtggaggagcagcagcttcccgataagatctcagggattgggctagtgggctcaagcatgcactaagaggcaaaatggcaaagtttaactggtatataaccttcctctgggaatttttgtctaatgaggggaaaaacacctcaagtgagcatgcacacaacttcagtaaacacactgtgtatgcaccccttcccaagtgctggcgggccactgtgcctgtggacagcctgccgcaagggagaaatcaagggaggagaaactcaaatcccggaaccaagccaatgtattaaaatcccaagccaaaggttggacggggcacttggatctctcaaggaacccacttgaccctcttccaagtgtgctttgcttcctttcactcaggctctaaaactttttaataaactctcacttttgctctaaaacttgcctcagtctctccctctgccttaaacatacttctgcccctcagccaaattctgtcctccagagaggcaaggat

SEQ ID NO: 334 - DNA, 1600 bp, Homo sapiens
gtcaggcctctgagcccaagctaagccatcatatcccttgccacatgcacatatacatccagatggcctgaagcaaatgaagaatcacaaaagaagtgaaaatggccggttcatgccttaactgataacattccaccattgtgatttgttcctgccccaccttaattgagtgattaaccttgtgaaattccttctcctggctcagaagctcccccactgagcaccttgtgacccctacccctgcctgcaagagaaaaatcccatttgactataattttccactatccacccaaatcctataaaacggccctacccctatctcgctttgctgacactcttttcagactctcttttcagactcagcttgcctgcacccaggggaaataaacagctttattgctcacacaaagcctgtttggtgggctcttcacctggacgcacgtgacatttggtgccgtgactcagatcaggagacctcccttgggagatcaattccctgtcctcttgctctttggtccatgagaaagatccacctacgacctccagtcctcagaccaaccagcccaaggaacatctcaccaattttaaatcaagtaagcggcctctttttactctcttatccaacctctgtcactatccctcaacctctttctactttcaatcatggcgccatccttcaatctctcacttctcttaatttcaattcctttccttttctggtagagacagaggagatgcgttttatccgtgaaaccaaaattccggttccaatcacagactcaggaagacagtcttcccttggcgtttaatcactgcggggacacctgcttgattattcacccacgtttcagaggtgtctgatcaccgtgggtatgcctgccttgatccttcacccttagtggcaagcaccactttcccggggggcaagcacccccccccccacaccccttctctctgtgtctctaccctctcttttctctgggcttgcctccttcactatgggcaaccttccaccctccattcctccttcttctcccttagtctgtgctctcaaaaacttaaaacctcttcaactcaaacctgacctaaaacctaaatgccttattttcttctgcaatgccacttgaccccagtacaaacttgacaatggttccaaatagccagaaaatggcactttctatttttccatactacaagatctagattatttttgtcataaaatgggcaaacggtctgagatgcctgacgtccagacattcctttacatattgatccctccctagtctctgttcccaatgcaactcatcccaaatcttccttctttccctcccgcctgtcccctaagtcccaatcccaagcattgctgagtctttccaatcttcattttctaccagcccatctgacctctcccctcctccccagactgccccaggtcactcccctccaggctgaatcaggctccaaatcttcctcagccttctctcccccacccttctatcacctcctctccccacaccccattcggcttacagtttcattccgagactagccttctcccacctgcccaacggttcctcttaaggaagtgactggagctaaa

SEQ ID NO: 335 - DNA, 3135 bp, Homo sapiens
tgactctctttttggactcagcccacctgcacccaggtgaaataaacagccatgttggtcacacaaagcctgtgtggtggtctcttctcatggacgcgcatgaaattcggtgccgtgactcggatcgggggacctcccttgggagatcaatcccctgtcctcctgctctttgctctgtgagaaagatccacctaccacctcaggtccttagacagacaagcccaagaaacatctcaccaatttcaaatccggtaagtggccactttttactctcttttccaatctccctcactatccctcaacctctttctcctttcaatcttggcgtcacacttcaatctctcccttctcttaatttcaattcctttcattttctgggagagacaaagcagacacgttttatcggtggacccaaaactccagcgcctgtcacggactgggaaggcagccttcccttggtgtttaatcattgcagggacacctctctgattattcacccacgtttcaaaggtgtcagaccacgcagggatgcctgccttggtccttcacccttagcagcaagtcccgcttttctgggggaggggcaagttccccaactccttctctccctctctaccccttctctgcttttctggggaaggggcaagtacccctcaaccccttctccttcgcccttagcggcaagtcccgcttttctagggggcaagaacccccaatcccttatttccgcaccccaacctcttatttctgtgccccaatcccttatttccatgccccgaccccccttcccacttttctggagggtaagaacccccgaaccccttccctccatatctctatgctctcttttctctgggtttgcctccttcactatgggcaaccttccaccatccattcctccttctcccttagcctgacttctcacgaacttaaaacctcttcaactcacacctgacctaaaacctaaacgccttattttcttctgcaatgctgcttgaccccaatacaaactcaacagtagttccaaatagccaaaaaatggcactttgaatttttccatcctgcaaaatctaaataattcttgctgtaaaatagacaaatggtctgaggtgcctgatgtccaggcattcttttacacatcagtcccttcctagtctctgtgcccaatgcaactcgtaccaaatcttccttctttccctcccgcctgtcccctcagtcccaaccccaagcgtcactgagtctttctaatcttccttttctacagacccatctgacctctcccctcctctccaggccaagctaggtcccaattcttcctcagcctcccctcctccaccctataatccttttatcacctcccctcctcacaccctgtctggcttatagtttcgttcagtgactagcccttccccacctgtccagcaatttattcttaaaaaggtggctgaagctaaaggcatagtcaaggtgaatgctcctttttctttatcccaaatcagatagcgtttaggctctttttcatcaaatataaaaatccagcccagttcatgacttgtttggctgcaaccttgagacgctttacagccctagaccctaaaaggtcaaaaggccatcttattctcaaaatacattttattacccaatgtgctcccgacattaaataaaattccaaaaattggaatctggccctcaaaccccacaacaggatttaattaacctcaccttcaaggtgtacagtaacagaaaaaaagttgcaattccttgcctccactgtgagacaaaccccagccacatctccagcacacaagaacttccaaatgcctgaaccacagcagccaggtattcctccagaacctccttccccaggagcttgctacacgtgccggaaatctggccactgggccaaggaatgccggcagcccgggattcctcctaagccgcgtcccatctgtgtgggaccccactgaaaatcggactgttcaactcacctggcagccactcccagagcccctggaactctggcccaaggctctctgactgactccttctcggcttagcggctgaagactgacgctgcctgatcacctcgaaagccccgtagaccatcacagacgccgagcttcgagtaactctcacagtggaaggtaagtccgtcgccttaatcaatacggaggctacccactccacattaccttcttttcaagggcctgtttcccttgcctccataactgttgtgagtattgacggccaggcttctaaacctcttagaactccccaactctggtgccaacttagatgatactcttttaagcactccttttagttatccccacctgcccagttcccttattaggccgagacactttaactaaattatctgcttccctgactattcctggactacagctacatctcattgccacccttcttcccaatccaaagcctcctttgcatcctcctcttgtattcccccaccttaacccacaagtataagatacctctactccctccttggcgactgatcatgcaccccttaccatctcattaaaaccttatcacccttaccctgttcaatgccaatatcccatcccacagcatgctttgaaaggattaaagcctgttatcactcgcctgctacagcatggccttttaaagcctataaactctccttacaattcccccattttgcctgtcctaaaaccagacaagccttacaagttagttcaggatctgtgccttatcaaccaaattgttttgcctatccaccctatggtgtcaaacccatatactctcctatcctccatacctccctccacaatccattattatgttctggatctcaagcatgctttctttactattcctttgctcccatcatcccagcctctcttcgctttcacttggactgaccctgacacccattaggctcagcaaattacctgggctgtactgctgcaaggcgtcacagacagcccccattacttcaatcaagcccaaatttcatcctcatctgttacctatctcagcataattcttcataaaaacacaggtgctccccctgctgctcgtgtccgattaatcccccaaacctcaatcccttacaaaacaactccttttcttcctaggtatggttag

SEQ ID NO: 336 - DNA, 450 bp, Homo sapiens
gtcaggcctctgaacccaagccaagccatcgcatcccctgtgacttgcacgtatacacccagatggcctgaagtaactgaagaatcacaaaagaagtgaaaatgccctgccccgcctttactgatgacattccaccacaaaagaaatgtaaatggccggtccttgccttaagtgatgacattaccttgtgaaagtccttttcctggctcatcctggctcaaaaagctcccccactgagcaccttgcgacccccacttctgcccgccagagaacaaagccccgttgactgtaattttcctttacctgcccaaatcttataaaacggccccacccctatctcccttcgctgactcttttcagactcagcccgcctgcacccaggtgaaataaacagccatgttgctcacacaaagcctgtttggtgatctcttcacagggacgtgcatgaaa

SEQ ID NO: 337 - DNA, 409 bp, Homo sapiens
gtcaggcctctgagcccaagctaagccatcatatcccctgtgacctgcatgtatacatccagatggcctgaagtaactgaagaaccacaaaagaagtgaaaatggcctgttcctgccttaactgatgacattaccttgtgaaattccttctcctggcttatcctggctcaaacgctctcccactgagcaccttgtgaccctcccggctgcccctgctgcctgccaggaaacaaccttctttgactgtaattttccactacctactcaaatcttataaaatggccccatccccatctcccttcgctgactctctttttggactcagcctgcctgcacccaggtgaaataaacagctttattgctcacacaaagcctgtttggtggtcccttcacaaggacatgagtgaaa

SEQ ID NO: 338 - DNA, 1015 bp, Homo sapiens
cttttaaatctaataacttgatttgtctccttgctttcaggccatcaagctatagatgatcttcagtgagggataccctcctctcaatattcaagagtcacccttctacgggtgacccctagactgcccatcagtgagacatgacagaggtgaaattctgccccgtctcccttgggacctggctggataccactttcaccaacccacagagccaccctgctgtgacaactagcaagaggctaagacccacagaaccaccaccacccctctgtcagcaggaagtagttacagaagactgcccttcatccatttcccccaaagaattggggtcttgaactccagaggggggaaatattatagcagttagctagtcaggcatgagcagagcaggaaagggctccccgataacaggaatttcaggcgactatcaggtgatggtcaggcagctgtcacactgtctctctaaattaataactggttgtagctggtgccagaaaaaggcagtctccaaatagacagaacacctgaaacgtgatcagcagcctccctataagatctcaggagttgggtgagtgggatcaagcatgcacattaagaggcaaaatggcagagtttaactggtacatgaccttccagggacatcccactggcaagggaagaatgcctcaagtgagcatgtgtgcaactccagtaaatacactgcacatgtgaacagcccaccctaagggaataatcaggggaagaggaacacaagatcccagaagtctgccaacatataaaaccccaagtcaaaaggtcaaactgcacacttatctttcaagtcgtctgcttggcccttttccaagtatactttccttccttttgttcctgctctaaagcttcttaataaactttcactcctgctctaaaacttgcctcagtgtctcctgccttcagcacctcagctgaattctttcttctgaggagaactgaggttgctgcagacccatatggattcgctactggtaacaatact

SEQ ID NO: 339 - DNA, 498 bp, Homo sapiens
atgaaatgagaccaccacttctcctgttgtccttcccagcttctccccaacctccccttttccctagtttataagacaggagaaaagggagaaagcaaaaagttggaaagcaacagaggtaagataaatagctagatgaccttggcaccaccatccggccctggtggttaaaataataataataatattaacccctgaccaaaactactggtgttacctgtaaattccagacattgtatgagaaagcattgtaaaactttttgttttgttagctgatgtatgtagcccccagtcatgttcctcacgcttacttgatctattatgaccctttcacgtggaccccttagagttgtaagcccttaaaagggctaggaatttctttttcggggagctcggctcttaagacgtgagtctgccgacgctcccagccaaataaaaaacttcttccttctttaatttggtgtctgaggagttttgtctgcgactcatcctgctaca

SEQ ID NO: 340 - DNA, 7387 bp, Homo sapiens
gagagacaggactagctggatttccaaggctgactaagaattcctaagcctagctggggaaggtgaccacacccacctttaaacatggggcttgtaactcagctcacaccagaccaatcaggtagtaaagagagctcactaaaataccaattaggctaaaaacaggaggtaaagaaataattaaatcacctatcccctgagagcacagggggaggcacaatgatcaggatataaacccaggcattcgagccagatcaggcaacgccctttgggtacccccccgttgaatgggagctctgttttcactctattaaatcttgcaactgcacactcttctggtccatgtttgttccagctcgagctgagctatcacttgctgtccaccactgctgatcatcgccatcgcagacccaccactgacttccacccctccggatccagcagggtgtccactgagcttctgatccagtgaggcacccattgctgctcccaatcgggctagaggctcaccattgttcctgcatggctaagtgcctgggttcgtcctaattgagctgaacactagtccctgggttccacagttctcttccatgacccacggcttctaatagagctataacactcaccgcatggcccaaggttccattccttggaatccgtgaggccaagaaccccaggtcagagagcaagaggtttgctgccattttggaagcggcccaccaccatcttgggagctctgggagcaaacactcatcggtaacatttgctgggctcgtatggggattctccaaagcggtgagtaatattgaaccactttcacttgctattctgtcctacccttccttagaattggaggaaaatactgggcacctgttggctggttaaaaatgattaatgtggccaccggacttaagactcaggtgtgaggctttctgggaaaaggctttctaacaatccccaacccttttgggttgggagcattggtctgcctggaaccagcttccacttttacagttttcttggggaagcagagggctgactagaggcagaaagctgtcgtcccaaattcccggcattggccggtcaagatcatggcgcagccagaagtctctactcaacagttgcccatgcgtgcacccctatctctccttctggcccatacctcctgggtcctaaccatgactttcttgaaagtgtagccccaaaattctccttacctctgaatctacttcctctgatccctgcctcctaggtactaatgcttcagactcacttcctctcccaagtattagagcaagttgtatctccaaagggatctaaggaagctctacgctgtgtccttaagcacctagggtatgaacccagggagtcttgtccctggtgtccctcccaatttagatatacagctctcgacatgggaagttatgtgggacctaccacccttgccagggccccaagtttgtaaatggctaggaggattgctctcccattgtgtaagatgctctcctcccccaatttctacccagcttacctcccccactgcaatacaatctctaagcctagactccttggccagggccttagaattgatgacccagtactttaacaactggaactgtgtctacgacaacagaatagatcaggaagaaagcgaattgagtaaattaaagggaggcgcatattcctatagaggcaaatgggggcaacgagcgaacattcttccgctgtgttcccaaaatccatctatcaagagagagaatgagagggaaagagaaacagagagagaaaggaaagagagagagaagagagagaaagaaagagagaggggggaagaaaggcagaaagtcaaagagaaagagagagacagtcaaagagagaaagaaagagagagatatataagtagttaagaaaaaaacagtgtaccctattcctttaaaagccagggtaaatttaaaacctataattgataattgaaggtcttctctatgaccctataacactccaataccactttgttgtcagttaaacagtgtaatgcaaacattaggaaaaaaacttcaaaagtccaccttaggcccagagcaaaacatagaaactctaatgaacttggcaacctcggtttttttcacaatagagatcaggaggagcaggcagaacaggacaaacgggccctcaggcaagcagaagttcacttcttgcccccatttgccactataggaatatgcacctccctttaatttactcaattcgctttcatcctgatctattgtgttgttgtaggcatagctccagttgttaaagtactgggtcatcagttctaaggccctggccaaggagccaaggcttggagattgtatcgcagcaggggaggtaagctgggtagaaattgggggaggagagcatcttactttggaggctctggaaaagggaaacgctgggcaaatcaaatgcctgatagggcttgcttccagtgtggtctacaaggacactttaaaaaagattgtctgaatagaaataagctgcccctcatccatgcccctcatgtcaagggaatcactggaaggcccactgccccaggggatgaaggtcctttcagtcagaagccactaaccagataagccagcagcaggactgagggtgcccggggcaagcgccagcccatgccccaggtatgcttgaccattgggggccagaaggttaactgtctcctgaacactggcatggccttctcagtcttagtctctggtcctggacaaccgtcctccagatctgtcactacccgaggggtcctaggataggcagtcactagatacttctcccagccactaagttgtgactggggaacttcattcttttcacttgcctttctaattatgcctgaaacccccacacccttgttagggagatacattctagcaaaagcaggggccattatacacctgaacatgggagaaggaacaccgtttgctgtcccctacttgaggaaggaattaatcctgaagtctgggcaacagaaggacaatatggatgagggaagaatgcccgtcccgttcaagttaaactaaaggattccgcctcctttccccaccaaaggcagtaccctcttagacccgaggcccaacaaggactccaaaagattgttaaggacctaaaagcccaaggcctagtaaaaccatgcaatagcccctgcaatactccaattttaggagtacagaaacccaatggacagtggaggttagtgcaagatctcaggattatcaatgaggctgttgttcctctatacccagctgtacctaatcttatactcactctgctttcccaaataccagaggaagcagagtggtttacagtcctggaccttaaggatgccttttactgcatccctgtacatcctgactctcaattcttgcttgcctttgaagatcctttgaatctaatgtctcaacacacctggactgttttaccccaagggttcatggacagcccccatctatttggccaggcattagcccgagacttgagccagttctcatacttgggcactcttgtccttcggtatgcggatgatttacttttagccacccattcagaaaccttgtgccatcaagccacccaagtgctcttaaacttcatggccacctgtggctacaaggtttccagaccaaaggctcagctctgctcacagcaggttaaatacttagggctaaaattatccagacacaccagggccctcagtgaggaatgcatccagcctatactggcttatccttatcccaaaaccataaagcaattaagagggttccttggcataacaggcttctgccgaatatggattcccaggtacagtgaaatagccaggccattatacacactaattaaggaaactcagaaagtgaatacccatttagtaagaaggacacctgaagcagaagtggctttccaggccctaaagaaggccctaatccaagccctagtgttaagcttgccaaaggggcaagacttttctttatgtgtcacagaaaaaacaggaatagctctaggattccttacacaggtccgagggaccaggttgcaacccatggcatacctgagtaaggaaactgatgtagtggcaaagggttggcctcattgtttatgggtaatggcagcagtagcagtcttagtatctgaagcagttaaaatgatacagggaagagatcttactgtgtggatgtctcatgatgtggacggcatactcactgctaaaggagacttacggctgtcagacaaccgtttgcttaaatatcaggctctattacttgaagggccagtgctgcgactgcgcactcgtgcaactcttaatccagccacatttcttccagacaatgaagaaaagataaaacataactgtcaacaggtgattgctcaaacctacgccgctcgaggggaccttctagaggtttccttgactgatcccgacctcaacttgtatactgacggaagttcctttgtagaaaaacgacttcgaaaagcagggtatgcagtggtcagtgataatggaatacttgaaagtaatcccctcactccaggaactagcgctcagctggcagaactaatagccctcactcaggcactaaaattaggagaaggaaaaagggtaaatatatacacagactctaagaatgcttacctagtcctccatgcccatgcagcaatatggagagaaagggaattcctaacttccgagggaacacctatcaaatctcaggaagccattaggagattacaattggctgtacagaaacctaaagaggtggcagtcttacactgccggggtgatcagaaaggaaaggaaagagaaatagaagggaaccgcgaagcagatactgaagccaaaagagccgcaaggtgggaccctccattagaaatgcttatagaaggacccctagtatggggtaatcccctgtaggaaaccaagccccagtactcaaaagaaataggatggggaacctcacgaggacatagtttcttcccctcaggatggctagccaccgaagaaggaaaaatacttttgcctgcagctaaccaattgaaattacttaaaacccttcatcagacctttcacttaggcattgatagcacctatcagacggccaaatcattattaactggatcaggacttttcaaaactatcaagcagatagtcagggcctatgaagtgtggcaaagaaataatcccctgccttatcgccaagctccttcaggagaacaaagaacaggccattacccaggagaagactggcaactagattttacccacatgcccaaatctcagggatttcagtatctactagtctggatagatactttcactggttgggaggaggcctttccttgtaggacagaaaaggccgaagacgtaataaaggcactaattcatgaaataattcccagattcggacttccctgagacttacagagtgacaatggccccgctttcaaggctgcagtaacccagcgagtatcgcagacgttacttaggcatacaatatcacttacactgcgcctggaggccacaatcctcagggaaggtcgagaaaatgaacgaaacactcaaacaacatctaaaaaagctaactcaggaaacccacctcgcatggcctgctctgttgcccatagccttattaagaatacaaaactccccccaaaaagcaggacttagcccatacgaaatgctgtatggacagcccttcctaaccaatgaccttgtgcttgaccgagagacggccaatttagttgcagacatcacctccttagccaaatatcaacaagttcttaaaacattacagggaacctgtacccgagaggagggaaaggaattccaccctggtaacatggtattagtcaagtcccttccctctaagtccccacccctagatacatactgggaaggaccctacccagtcattttatctaccctgagtgcagttaaagtgtctggagtggagtcttagacacatcaaaccctggataccgccaaaggaacccaaaaattcaggagacaacgctagctattcctgtgaacctctagaggatctgcacctgctcttcaagcgacaactgcgaggaaagtaactggaatcgtagagctccatggccccccccgtcatatttttctctttactgttgtcttacccccctttcactatcacctcaccccctccatgccgctatactaccagtagctccccttaccaagagcttctatggagaatgcggcttcccagaaatattgatgccccattgtataggagtttttctaaaggaaaccccactttcaccatccacacccatatgcccctgcacttcgggccacacatttcaatccctgtatctttaacctccttgttaagtttgtctcttccagaatcaaagctgtgaaactacaaatgttcttcaaatggagccccagatgcagtccatgactaagatctaccgtggacccctggactggcctgctagcccatgctccgatgttgatgacatcgaaggcaccactcccgaggaaatctcaactgcatgacctctactacgccccaattcagcaggaagcagttacagcggtcatcggccaacctccccaacagcacttgggttttcctgttgagagggggtactaagagacaggactagctggacttcctaggccgactaagaattcctaagcctagctggggaaggtgaccacacccacctttaaacatggggcttgtaactcagctcacaccagaccaatcaggtagtaaagagagctcactaaaataccaatgaggctaaaaacaggtggtaaagaaataatcagatcatctgtcgcctgagagcacagggggagggacaatgatcaggatataaacccaggcattcaagccgaatcgggcaaccctctttgggtcccctcccgttgcatgggagctctgttttcacgatattaaatcttgcaactgcacacttttctggtccatgtttgttccggtttgagctgagcttttgcttgccatccaccactgctgatggctgctgtcgcagacgccccgctgacttccacccccctccagatccagcagggtgtccactgcgcttctgatccagcgaggcaccggttgctgctcccgggctagagactcgccattgttcccgcacagctaagtgcctgggttcatcctaattgaggtgaacactagtcgctgggttccacagttctcttccgtgacccacagcttctaatagagctataacactcaccgcatggcccaaggttccattccttggaatccatgaggccaagaaccccaggtcagagagcaagagccttgctgccattgggaccggcctgccaccaccctgggag

SEQ ID NO: 341 - DNA, 968 bp, Homo sapiens
ggtatgtgtggggaaaagcaagagagatcagactgttactgtgtctgtgtagaaagaagtagacataggagactccattttgttctgtactaagaaaaattattctgccttgagattctgttaatctatgaccttaccaccaaccccgtgctctctgaaacatgtgctgtgtcaaactcacggttaaacggattaagggttgtgcaagatgtgctctgttaaacagatgcttgaaggcagcatgctccttaagagtcatcaccactccctaatctcaagtacccagggacacaaaaactgtggaagcctgcagggacctctgcctaggaaagccaggtattgtccaaggtttctccccatgtgatagtctgaaatatggcctcgtgggaagggaaagacctgaccatcccccagcccgacatccgtaaagggtctgtgctgaggaggattagtataagaggaaggcatgcctcttgcagttgagacaagaggaaggcatctgtctcctgcccgtccctgggcatggaatgtctcagtataaaacccgattgtacgttccatctactgagatagggaaaaaccgccttagggctggaggtgggacatgtgggcagcaatactgctttgtaaagcattgagatgtttatgtgtatgcatatctaaaagcacagcacttgattctttaccttgtctatgatgcaaagacctttgttcacgtgtttgtctgctgaccctctccccactattgtcttgtgaccctgacatagccccctctcggagaaacacccacaaatgatcaataaatactaagggaactcagaggctggcgggatcctccatatgctgaacgctggttccccggatccccttatttctttctctgtactttgtgtctttttcttttccaagtctctcattccacctaacgagaaacacccacaggtgtggaggggcaacccaccccttca

SEQ ID NO: 342 - DNA, 5725 bp, Homo sapiens
gtcaggcctctgagcccaagccaagccatcgcatcccctgtgacttgcacgtatacgcccagatggcctgaagtaactgaagaatcacaaaagaagtgaatatgccctgccccaccttaactgatgacattccactacaaaagaagtgtaaatggctggtccttgccttaagtgatgacattaccttgtgaaagtccttttcctagctcatcctggctcaaaaagcacccccactgagcaccttgcgacccccactcctgcccgccagagaacaaaccccctttgactgtaattttcctttacctacccaaatcctataaaacagctccacccctatctcccttcactgactctcttttcggactcagcccccctgcacccaggtgaaataaacagccatgttgctcacacaaagcctgtttggtgatctcttcacatggatgcacatgaaatttggtgctgtgactcagatcgggggacctcccttgggagatcaatcccctgtactcctgttctttgctccatgacaaagatccacctatgacctcaggtcctcagaccgaccagcccaaggaacatctcaccaattgtaaatcaggtaagcggcctcttcttactctcttctccaacctctctcactgtccctcaaccactttctcctttccactcttcagtctctcccttctcttaatttcaattcctttcattttctgggagagacaaaggagacacattttatccgtggacccaaaactctggcgccggtgacggactgggaaggcagccttcccttggtgtttaatcattgcagggatgcctctctgattatacactcacgtttcaagggtgtcagactatgcagggacgcctgccttggtccttcacccttagtggcaagtcccgcttttctacagggcaagaacccccaatcccttatttccatgccccaacctcttatctctgtgccccaatcccttatttctgcaccctgacctcttatctctgtgtcccaatcccttatttccgtgcccagacctcgtatctctgtgccccaatcccttatttctgcgccccaacctgttatatctctgtgccccaatctcttatttccacaccctgacctcttatctctgtgccccaaccccttttcccacttttctggaaggtaagaacccccaactccatttctctactctctcttttctctaggcttgcttccttcactatgggcaaccttccaccctccattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaaaatctaaataattcttgtcgtaaaataggcaaacggtctgaggtgcctgatgtccaggcattcttttacacatcagtcccttcctagtctctgtgcccagtgcaactcgtcccaaatcttccttctttccctcccgcctgtcccctcagtcccaaccccaagcatcgctgagtctttctaatcttccttttctacagacccacctgacctctcccctcctccccaggctgctcctcgccaggccgagccaggtcccaattcttcctcagcctctgctcctccaccctataatctttttatcacctcccctcctcacacctggtccggcttacagtttcgttccgtgactagccctcccccacctgccctgcaatttactcttaaaaaggtggctggagccaaaggcatagtcaaggttaatgctcctttttctttatcccaaatcagaagtgtttaggctctttttcatcaaatataaaaacccagcccagttcatggctcgtttggcagcaaccctgagacactttacagccctagaccctaaaaggtcaaaaggctgtcttgttctcaatatacattttattacccaatctgctcccgacattaaataaaactccaaaaattggaatctggccctcaaaccccacaacaggacttaactaacctcaccttcaaggtgtacaataacagaaaaaagttgcaattccttgcctccactgtgagacaaaccccagccacatctccagcacacaagaacttccaaacgcctgaaccacagcagccaggagttcctccagaacctcctcccccaggagcttgctacacgcgccggaaatctggccactgggccaaggaatgcccgcagcccaggattcctcctaagctgcgtcccatctgtgtgggaccccacacagaaaatcggactgttcaactcacctggcagccactcccagagcccctggaactctggcccaaggctctctgactccttcccagatcttctcggcttagcggctgaagaccgacactgcccgatcgcctcagaagccccctagaccatcacggacgccgagctttgggtaactctctcagtggaaggtaggcccgtccccttcttaatcaatatggaggctacccactccacattaccttcttttcaagggcctgtttcccttgcctccataactgttgtgggtattgacggccaggcttctaaacctcttaaaactccccaactctggtgccaacttagacaatactcttttaagcactcttttttagttatccccacctgcccagttcccttattaggctgagacactttaactaaattatctgcgtccctgactattcctggactacagctatatctcattgctgcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccaatatcccatcccacagcacgctttaaaaagattaaagcctgttatcactcacctgctacagcatggccttttaaaacctataaactttccttacatttcccccattttacctgtcctaaaaccagacaagccttacaatttagttcaggatctgcgccttatcaaccaaattgttttgcctatccaccccgtggtgccaaacccatatactctcctatcctcaatacctgcctctactacccattattctgttctggatctcaaacgtgctttctttactattcctttgcacccttcatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcataattctcataaaaacacacatgctctccctgccaattgtgtctgactgatctctcaaacctaagcaccttctacaaaacaacaactcctttccttcctaggcatggttagcacggtcagaattcttacacaagagccaggaccacaccctgtagcctttctgtccaaacaacttgaccttactgttttagcctagccctcatgtctgcgtgcagtggctgccgctgctttaatacttttagaggccctcaaaatcacaaactgtgctcaactcactctctacagttctcataacttccaaaatctattttcttcctcatacctgacgcatatactttctgctccccggctccttcagctgtactcactctttgttgagtctcccacaattaccgttgttcctggcccagacttcaatccggcctcccatattattcctgataccacacctgacccccatgactctatctctctgatccacctgacattcaccccatttccccagatttccttctttcctgtgcctcaccctgatcacgcttgatttattgatggcggttccaccaggcctaattgccacacaccagcaaaggcaggttatgctatagtacaagccactagcccgcctcttagaacctctcatttcctttccatcgtggaaatctatcctcaaggaaataacttctcagcattccatctgctattctactactcctcagggattattcaggccccttcccttccctacacatcaagttcgaggatttgcccgacccaggactggcaaattagctttactcaacatggcctgagtcagacaactaaaatacctcttagtctgggtagacactttcactggataggtacaggcctttcctacagggtctgagaaggccaccgcagtcatttcttctgttctgtcagacataattcctcagtttagccttcccacctctatacagtctgataacagaccagcctttattagtcaaatcagccaagcagtttttcaggctcttagtattcagtgaaacctttatatcccttatggtcctccatcttcaagaaaagtagaatggactaaaggtcttttaaaaacatacctcaccaagctcagccaccaacttaaaaaggactgggcaatacttttaccactttcccttctcagaattcaggcctgtcctcagaatgctacagggtacagcccatttaagctcctgtatagacgctcctttttattaggccccagtctcattccagacaccagaccaacttagactgtgccccccaaaaaacttgtcatccctactatcttctatctagtcatactgctattcaccattctcaactactcacacatgccctgctcttatttacactgccagtttacactgtttttccaagccgtcacatctgatatctcctggtattatccccaaactgccactcttaactcttgaagtaaataaataatctttgctggcaggactatgctgaatctccttaggcactctctaatcagatatcctgagtcatgccaactcttagaccttttatacctgtttttcttcttctgttattccatttagtttctcaattcatacaaaaccgtatccaggccatcactaatcattctatacaacaaatgtttcttctaacatccccacaatatcaccccttaccacaagacctcccttcagcttaatctctcccactctaggttcccacagcacccctaatcccgcttgaagcagccctgagaaacattgcccattctctctccataccaccccccaaaaattttcgctggcccaacacttcaacactattttgttttatttttcttattaatataagaagtcaggaatgtcaggcctctgagcccaagccaagccatcgcatcccctgtgacttgcacgtatacacccagatggcctgaagtaactgaagaatcacaaaagaagtgaatatgccctgccccaccttaactgatgtcattccactacaaaagaagtgtaaatggcctgtccttgccttaagtgatgacattaccttgtgaaagtccttttcctggctcatcctggctcaaaaagcacccccactgagcaccttgcgacccccactcctgcccgccagagaacaaacaccctttgactgtaattttcctttacaaatcctataaaacgcccccccctccccatctcccttcattgactctcttttcggactcagcccgcctgcacccaggtgaaataaacagccatgttgcttacacaaagcctgtttggtgttctcttcacacggacgcgcatgaaa

SEQ ID NO: 343 - DNA, 5612 bp, Homo sapiens
ctgccttaaatgatgacattccaccacaaaagaagtgaaaatggcctgttcctgccttaactgatgacattgtcttgtgaaattccttctcctggctcatcctggctggaaagctcccctactgagtatcttgtgacccccactctggccaccagagaacaaccccgctttgactgtaattttcctttatttacccaaatcctataaaacgtccccacccttatctcccttggctgaccctcttttcggactcagcccagctgcacccaggtgaaataaacagctttattgctcacacaaagcctgtttggtggtctcttccatggatgcaagtgaaatttggtgccatgactcggatcagggtacctcccttgggagatcaatcccctgtcctcctgctctttgctccatgagaaaggtccacctatgacctcaggtcctcagaccgaccagcccaagaaacatctcaccaatttcaaatccagtaagcagcctatttttactctcttcttcaacctccctcactatccctcaacctcgttctcctttcaatcttggcgccacacttcaacctctcccttctcttaatttcaattcctttcattttctggtagagacaaaggagacattttatccgtggacccaaaactccagcgcctgtcacagactgggaaggcagccttcccttggtgtttaatcattgcagggacacctctgattattcactcatgtttcagaggtgtcataccatgcaaggatgcctgccttggtccttcacccttagcagcaagtcctgcttttcttggggaggggcaagtaccccaaccccttctctccgtgtctctaccccttctctgcttttctgaaggagaggcaagaacccctcaaccccttctctttcacccttagcggcaagtcccgcttttctaaaggaggggcaagtaccccgacctcttatctctgtgcccccatcccttatttccacaccccgacctcttatctccgtgccccaaccccttatttctgtgccttgaccccttttctgcttttctggaaggtaagaactcccaaaccccttccctctgtgtctctactctctcttttttctaggcttgcctccttcactataggcaaacttccaccctccattcctcctccttctcccttagcctgtgttcttaagaacttaaaacctattcagctctcacctgacctaaaatctaagcgtcttattttcttctgcaatgctgcttgaccccaatacaaactcacagtagttccaaatagccagaaaacggcactttcaatttttccatcctgcaagatctaaagaattcttgtggtaaaataggcaaacggtctgaggtgcctgacgtccaggcattcttttacacatcagtcccttcctagtctctgtgcccagtgcaactcatcccaaatcttccttctttccctcccgcctgtcccctctgtcccaaccccaagcgtcgctgagtctttctaatcttccttttctacagacccatctgacctctcccctcctccccaggctgctcctcgccaggccaagctaggtcccaattcttccccagcctccagtcctccaccctgtaatctttttatcacctcctctcctcacacccggtccagtttacagtttaattccgtgagtagccctcccctacctgcccagcaatttcctcttaaaaaggtggctaaagctaaaggcatagtcaaagttaatgctcctttttctttatcagacctctcccaaatcagtgagcatttaggctgtttcatcaaatatgaaaaacccagcccagttcatggcttattcggcagcaaccctgagacgctttacagccctagaccctaaaaggtcaaaaggccgtcttattctcaatatacattttattacccaatctgctcccgacattaaataaaactccaaaaattaaattctggccctcaaaccccacaacaggacttaattaacctcaccttcaaggtgtacaataatagagtagaggcagccaagtagcaacgtatttctaagttgcaattatttgcctccacggtgagacaaaccccagccacatctccagcacaacaagaactccaaatacctgaaccacagctgccaggggttcctccagaacctcctcccccaggagcttgctacaagtgccggaaatctagccactaggccaaggaaggcccacagcccaagattcctcctaagccatgtcccatctgtgcaggaccccactgaaaattagactgttcaactcacctggcagccacttccagagcccctggaactgtggcccaaggctctctgactgactccttcccagatcttctcagcttagcagctgaagactgacactgcctgatcgcctcagaagcctacaggaccatcacagatgctctaagtaactctcacagtagaaggtaagtccgtccccttcttaatcaatacggaagctactcactccacattaccttattttcaaaggcctgtttcccttgcttccataactgttgtgcgtattgacagccaggcttctaaacctcttaaaactccccaaatctagtgccaacttagacaatactcttttaagcactcctttttagttatccccacctgcccagttcccttattaggccgagacactttaactaaattatctgcttccctgactattcctaggctacagccacacctcattgctgccttttctcccagttcaaagcctccttcacatcctccccttatatctccccaccttaacccacaagtataagacacctctactccctccttagtgaccgatcatgcaccccttaccatcccattaaaacctaatcactcttaccccgctcaatcccaatatcccatcccacagcatgctttgaaaagattaaagcctgttatcacttacctgttacagcatggccttttaaagcctataaactcttcttgccattcccccattttacctgtcctaaaaccagacaaggcttacaggttagttcagaatctgtgccttatcaaccaaattgttttgcctatccaccccatggtgccaaacccatatactctcttatcctcaatacctccctctacaacccattattctgttctagatctcaaacatgctttctttactattcctttgcacccttcatcccagcctctctttgctttcacttaggctgaccctgacacccattaggctcagcaaattacctgggctgtactgccacaaggcttcacagacagcccccattacttcagtcaagcccaaatttcatcctcatctgttacctatctcggcataattctcataaaaacacacgtgctctccctgctgattgtgccaattaatctcccaaacctcaatcccttataaaacaacaactcctttccttcctaggcatggttagtgcggtcagaattcttacacaagagccaggaccgcaccctgtagcctttctgtccaaacaacttgaccttactgttttagcctagccatcatgtctccgtgcagcggctgctgctgccctaatacttttagaggccctcaaaatcacaaactatgctcaactcactctctacatttctcataacttccaaaatctattttcttcctcatagctgatgcatatactttctgctccccggatccttcagctgtactcactctttgttaagtcccacaattatcattgttcctggcccggacttcaatctggcctcccacattatacctgataccacacctgacccccatgactgtatccctctgatccacctgacattcaccccatttccccatatttccttctttcctgtgcctcaccctgatcacacttagtttattgatggcagttccaccaggcctaatcaccacacaccagcaaaggcaggctatgctatagtacaagccactagcccgcctcttagaacctctgatttcctttccatcgtggaaatctatcctcaaagaaataacttctcagtgctccatctgctattctactacttctcaaggattattcaggccccctcccttccctacacatcaaactcaagggtttgcccctgcccaggactagcaaattgactttactcaacatgccctgagtcaggaaactaaaatacctcttggtctaggtacacactttcactagataggtagaggcctttcccacaaggtgtaagaaggccaccacggtcatttcttccctgctgtcagacataattcctcagtttggccttcccacttctacacagtccgatagaagactggcctttgttagtcaaatcagccaagcattttttcaggctcttaatatccagtgaaacctttatatcccttacagtcctcagtcttcaggaaaagtagaacggactaatagtcttttaaaacacacctcaccaagctcagccaccaacttaaaaaggactagataatacttttaccactttcccttctcagaattcaggcctgtcctcagaatgctacaaggtacatcccatttaagctcctgtatagacgctcatttttattaggccccagtctcattccagacaccagaccaacttggactgtgccccaaaaaacttgtcatccctactatcttctgtctagtcattcctattcactgttctcaactactcatacatgccctgctcttgtttacactgccagtttacactgtttctccaagccatcacagctgatatctcctagtgctatccccaaactgccactctaaactcttgaagtaaataaataatctttgctggcaggactatgctgaatctccttaagcactctctaatcagatgtcctaggtcctcccaattcttagaccttttatacctgtttttctccttctcttattccatttagtttttcaattcatacaaaaccatatccaggccatcaccaataattctacaggacaaatgtttcttctaacaaccccacaatatcaccccttaccacaaaatcttccttcagctgaatctctcccactctaggttcccgcgccgcccctaatcccgctcgaagcagccctgagaaacatcgcccattatctctccataccacccccaaaaattttcaccatctcaacactttaccactatttcattttatttgtcttattaatataagaagacaggaatgtcaggcctctgagcccaagctaagccatcatatcccctgtgaccttcatgtacacatccagatggctggttcctgccttaactgatgacattctaccacaaaagaagtgaaaatggcctgttcctgccttaactgatgacattgtcttgtgaaattccttctcctggctcatcctggctcaaaagctcccctactgagcaccttgtgacccccactctgcccaccagagaacaacccccctttgactgtaattttcctttatctacccaaatcctataaaacggccccacccttatttcccttcactgactctcttttcagactcaggccacctgcacccaggtgaaataaacagctttattgctcacacaaagcctgtttggtggtctcttcacagggacatgaatgaaa

SEQ ID NO: 344 - DNA, 453 bp, Homo sapiens
ttacagtaggtaggcaggcagggatgagcaggaaaagatagggcccccaccccaaccaggaatgtcaggtaaccattaggtgatggtcaggcagttgttaaactgtctctctaaaataataattagtcacagccagcactaagaaaaggcaattttccattagaaagaaaacacctgaagtgggtgatcagcaggaagatctcaggagttgggtgagtggacttgagcatgtgcactaagaggcaaaatggcggagtttaactggtatgtgaccttcctctacacctgactggtaagggaagaatgcctcaagtgagcatgcatacaacttcagtgaacacactgtgcatgcagcccttcccaagtgctggccagccactgtacatgcggacagcccaccccaagggaagaatcaggggagaaggagtgcagaccccggaagcatgctgatat

SEQ ID NO: 345 - DNA, 2380 bp, Homo sapiens
gtggtcagaattcttacacaagagctgggactgcaccgtgtagcctttctgtcgaaacaacttgaccttactgttttagcatagccttcctatctgcatgcagtggctcctactgccttaatactttttagaggccctcaaaatcacaaactatgctcaactcacgctctacagttctcgtaacttccaaaatatattttcttcctcacacctgatgcatatactttcttgccccccttcactacctctcagaaagccaaactcattgccttaacttgagccctcactcttgcaaaaggactacacgtcaatatttatactgacgctaaatatgccttccataccctgcaccagcatgctgttatataggcaaaaagaggtttcctcactactcaagggtcctccatcattaatgcctctttaataaaaatgcttctcaaagccgctttacttccaaaggaagctggagtcacttactgtgaaggccatcaaagggcatcagatcccatcactcaggacaatgcttatgctgataagttagctaaaaaagcagctagcattccaacttctatccctcatggcagtttttcttcttctcatctggccactctcacctactcccccgctgaaacttcaacctatcaatctcttcccacacaaggcaaatggttcttgacccaaggaaaatgtctccttccagcctcacaggcccattctattctgttgtcatttcataacctctttcatgtaggttacaagccgctagcccgcctcataggacctctcatttcctttcaatcatggaaatctatcctcaaggaaatcacttctcagtgttccatctgctattctactacccctcagggatttctcaggccccctcccttccctacacatcaagctcggggatttgccccaacccaggactggcaaattgactttactcacgtgcctcgagtcaggaaactaaaatacctcttggtctaggtagacactttcaatggatgggtagaggcctttcccacagggtctgagaaggccaccatggtcatttcttcccttctgtcataaataattcctcagtttggcctttccacctctatatagtccgataacagactggcctttattagttaaatcacccaagcagtttctcaggatcttggtattcagtgaactaatggtcttttaaaaatacacctcaccaagctcagccaccaacttgaaaaggactggacaatacttttaccactttcccttctcagaacttgggcctgtccttggaatgctacagggtacagcccatttcagctcctgtatgggcgctcctttttattaggccccagtctcattccagacaccagaccaacttggactgtgccccagaaaacttgtcatccctactatcttctgtctagtcattctcctattcaccattctcaactactcataaatgccctgctcttgtttacactgccggtttacactgtttctccaagccatcatagctgatatctgctggtgctatccccaaacctccactcttaactccctcttaaagtaaataagtaatctttgctggcaaggctatgctgaacccccttgagcactgtctaattggatgtcctgggtcctcccaattctaagtcatttaatatctgtttttcttcttctcttaattcggaccttgtgtcttccatttagtttctcaattcatacaaaaccacatccaggccatcaccaatcattctatatgacgaatgctccttttaacaaccccacaatatcaccccttaccacaaaatcttccttcagcttaatctctcccactctaagttcccacaccgcccctaatcctgctcaaagcagcctgagaaacattgcccattatctctccataccactcccaaaattttcgccacccaacactttaccactatttcattttatttttcttattaatataagaagacaggaatgtcaggcctctgagcccaagctaagccatcatatcccctatgacctgcacatacacctccagatggctggtttctgccttaactgatgacattccaccacaaaagaagtgaaaatggcttgttcctgccttaactgatgacattaccttgtgaaattccttctcctggctcatcctggctcaaaagctcccccactgagcactttgtgacccccgcccctaccggccagagaacaaccccctttgactgtaattttctttacctacccaaatcctataaaatggccccacccctatctcccttcactgactctcttttcggactcagcccgcctgcacccaggtgaaataaacagccttgttgctcacacaaagcctgtttggtggtctcttcacacggac

SEQ ID NO: 346 - DNA, 323 bp, Homo sapiens
tgggtcaggcacaaagtaagcccaccccaccaggaactatgttgaaaaatttcaagaaaggatttaagggagattacggtgttactatgacaccaggaaaacttagagctttgtgtgaaatagactggccagcattagaggtaggttggccatcagaaggaagcctggacaggtcccttgtttcaaaggtatggcacaatgtaacctgtaagccagggcacccagaccagttcctgtacatagacacttggttacagctggttttagacaccccatccccgccccacagtggttgagagaacagcagcataagtggctggcag

SEQ ID NO: 347 - DNA, 1003 bp, Homo sapiens
gtcaagcctctgagcccaagccggcctgtatacatccagatagcctgaagcaactgaagaatcacaaaagaagtgaaaatggccggttcctgacttaactgatgacattaccttgtgaaattccttctcctggcccaggagctccccaccaagcaccttgtgacccccgccctgccctcaagagaacaaccccctttgactgtaattttccactacccacacaaatcctataaaactgcctcacccctagttccctttgctgactcttttttcagattcagcccacctgcacccaggtgattaaaaagctttattgctcacacaaagcctgttggtggtctcttcacatggacacgcatgacatttaggtgccgaagatccaggacagggggactcctttgggagacctgtcccttgtccttgcactcactctgtgaggagatccacctactgtcaggcctctgagcccaagctaagccatcatatccccctgtgacctgcacttatacatccagatggcctgaagcaactgaagatccacaaaagaagtgaaaatagccaggtcctgccttagctaatgacattccaccattgtgatttgttcctgccccaccctaactgatcaattgactttgtgacaatacaccctccccgcccttgtgataatgtactttgtgatattcccccatccttgtgaatgtgctttgtacaatacaccctgcccacccttaagaaggtactttgtaatattctcccctgcccttaaggtactttgtaatattctccccacccttaagaatgtactttgtaagatctaccccctgatcgcaaaaaaattgctcctaaccccaccgcctatctcaaacctataagaactaatgataattccaccaccctttgctgactctcttttcagactcagcccacctgcacccaggtggttaaaaagctctattgctcacacaaagcctgtttagtggtctcttcacatggatgcacgtga

SEQ ID NO: 348 - DNA, 5755 bp, Homo sapiens
gtcaggcctctgagccaaagctaagccatcatatcccctgtgacctgcacgtatacatccagatggcctgaagtaactgaagaatgacaaaagaagtgaaaatggccttttcctgccttaactgatgacattaccttctgaaattccttttcctggctcatcctggctcaaaagctcccccactgagcaccttgtgatccccacccctgcccaccagagaacccccctttgactgtaattttcctttacctacccaaatcttaaaaaatggccccaccccatctcccttcgttgactctcttttcggactcagcctgcctgtacccaggtggttaaaaagctttattgctcacacaaagcctgtttggtggtctcttcacacggacgtgagtgaaatttggtaccgtgactcagatcgggggacctcccttgggagatcaatcccctgtcctcctgctctttgctccatgagaaagatccacctacgaccttgggtcctcagattgaccacccaaggaacatctcaccaattttaaatcgggtaagtggccttttttcactcccttctccaacctctcttagtatccctcaacctctttctcctttcaatcttggtgccacacttcagtctctcccttctcttaatttcagttcctttccttttccggtagacacaaaggagatgcattttatccatgaacccaaaactccggcactggtcacagactcaggaagagagtctcccttggtgtttaatcacacggggatgcctgcctgattattcacccacatttcagaggtgtctgaccatgtggggatgcctgccttggtccttcacccttagtggaaagtaccgcttttctggggggcaagaaccccctgaccccttctctctgtgtctctaccccttttctgcttttctagggggcaagaatcccccaaccccttctctccgtgtctccacctcttctccacttttctgaggggcaagaaccccctgaacccttctctccatgtctctaccccttctccactttcctagggggcaagcacccctgacgccttctctctatgtctctactctctcttttctctgggcttgcctccttcactatgggcagccttccaccctccattcctccttcttctcccttagcctgtgttctcaagaacttaaaacctcttcaacttacacctgacctaaacctaaatgccttatcttcttctacaatgctgcttgaccccaatacaaactcgacagtggttccaaatagccagaaaacagcacttttgatttttccatcctacaagatctagataattcttgtcataaaataggcaaacggtctgaggtgcctgacatccaggcattcttttacacattgttcccttcctactgtctgttcccaatgtgacttgtcccaaatcctccttctttccctcctgcctgtcctctcagtcccaaccccaggcgttgctgagtctttctaatcttccttttctacagacccatctgacttctcccctcttccccaggctgctcctcgccaggctgagccaggtcctaattcttcctcagcctctgctcccccaccctataatccttttatcacctcccctcctcacacccagtctggcttatagttttattccacgactagccctccccaacctgcccagcaatttcctcttaaaaaggtggctggagctaaaggcatagtcaaggttaatgctcctttttctttatctgaactctcccaaatcagttagcatttaggctctttcatcaaatatgaaaaacccaacccagttcatggcttgttcggcagcaaccgagacactttacagccctagaccctaaaaggtcaaaaggtcatcttattctcaatatacattttattatccaatccactcctgacattaaataaaactccaaaaattaaattctggccctcaaaccccacaacaggacttaattaacctcaccttcaaggtgtacaataatagagtagaggcagccaagtagcaatgtatttctgagttgcaattccttgcctccattgtgagacaaaccccagccacatctccagcacatgaaaactccaaatgcctgaaccgcagctgccagggattcctccagaacctcctcccccaggagcttgctacaagtgccagaaatctggccactgagccaaggaatgcccacagtccaggattcctcctaagctgtgtcccatctgtgtggaaccccactgaaaattggactgttcaactcacctggcagccacttccagagcccctggaactctggcccaaggctctctgactccttcccagatcttctcagcttagtggctgaagactgacactgcccgatcgccttggaagcctacaggaccatcacagacgctctaggtaagtctcacagtggagggtaagtccgtccccttactcaattcggaggctacccactccacatcaccttcttttcaagggcctgtttcccttgcctccataactgttgtgagtattgacagccaggcttctaaacctcttaaaactctccaactctggtgccgacttatacaacattcttttatgcactcttttttagttatccccacctgcccagttcccttattaggctgagacattttaactaaattatctgcttccctgactgttcctggactacagccacacctcattgctgcccttttccccagttcaaagcctcctttgcatcctcctctcatatccccccaccttaacccacaagtataagatacctctactccctccttggtgaccgatcatgcaccccttaccatcccattaaaacctaatcacccttaccccgctcaatgccaatatcccatcccacagcacgctttaaaaggattaaagtctgttatcactcgcctgctacagcatggccttttaaagcctataaacttcccttacaattcccccattttacctgttctaaaaccagacaaaacttacaggttagtttgggatctgcgccttgtcaaccaaattattttgcctatccaccccacggtgccaaacccatatattctcctatcctcaatacctccctccacaacccaatattctgttctggatctcaaacatgccttctttactattcctttgcacccttcatcccagcctctcttcgctttcacttggcctgactgacacccatcaggctcagcaaattacccgggctgtactgcctcaaggcttcacagacagcccccattccttcagttgaacccaaatttcttcttcatctgttacctatctcagcataattctcataaaaacacacatgctctccctgctgatcgtttccaactgatctctcaaaccccagcaccttctacaaaacaacaacccctttccttcctagtcatggttagatacttttgactttaggtacctgattttgccatcctaacaaaaccattatataaactcacaaaaggaaacctagctgaccccatagatcctaaatcctttccccactcctctttccattccttgaagacagctttagagactgcccccaccctagctctccctgactcatcccaacccttttcattacccacagccgaagtgcagggctgtgcagttggaattcttacacgagaacccacactgcgccctgtagcctttttatccaaacaacttgaccttactgttttgcctagccctcaagtctgcgtgcggcggccgccaccaccctaatacttttagaggcccttaaaatcacaaactatgctcaactcactctctacagttctcataacttccaaaatctattttcttcctcacacctgacacatatactttttactccctggctccttcagctgtactctttgttgagtctcccacaattaccattgttcctggcccggacttcaatctggcctcccaccttattcctgataccacacctgacctccatgactgtgtctctctgatccacctgacattcaccctatttccccatatttccttctttcctgttcctcaccctgatcacacttggtttattgatggcagttccaccaggcctaatcaccacacaccagtaaaggcaggctatgctatagaacaagccactatcccacctcttagaacctctcctttcctttccatcatggaaatctatcctcaaggaaataacttctcggtgttccatctgctattctactactcagggattattcaggccccctcccttccctacacatcaagctcagggatttgcccccacccaggactggcaaattggctttattcaacatgccccgagtcaggaaactaaaatacctcttggtctaggtagacactttcactggataggtaaaggcctttcccacagggtctaagaaggccaccacggtcatttcttcccttctcttagacaaaattcctcggtttggccttcccacctctagtcctataatggactggcctttattagtcaaatcacccaagcagtttctcaggctcttagtattcagtgaactaatggtcttttaaaaacacaccttaccaagctcagccaccaacttaaaaaggactggacaatacttttaccacttgcccttctcagaattcaggcctgtcctcacaatgctacaaggtacagcccagttaagctcctgtatagacactcctttttattaggccccagtcttattccagacaccagaccaacttagactgtgcccccaaaaacttgtcattcctactatcttctgtctagtgatactcctattcactgttctcaactactcataaatgccctgctcttgtttacactgccagtttacactgtttctccaagccatcacagctggtatctcctggtgctatccccaaaccgcctctcttaactcttaaagtaaataaataatctttgctggcaaggctgtgctgaacctccttaggcactctaattagatgtcctaggtcctcccaattcttagtcctttgatacctgtttttctccttctcttattccatttagtttttcaattcatacaaaaccatatccaggccatcaccagtaattctacacgacaaatgtttcttctagcaaccccacgatatcaccccttaccacaaaatcttccttcagcttaatctctcccactctaggttcccacgccgcccctaatcccgctcgaagcagccctgagaaacatcacccattatctctccataccaccccccaaaattttcgccgccccaacactttaccccatttcattttatttttcttattaatataagaagacaggaaaatcaggcctctgagcccaagctaagccatcatatcccctgtgacctgcacgtataaatccagatggcctgaggtaactgaagaatgacaaaagaagtgaaaatggcctgttcctgccttaactaataacattaccttctgaaattccttttcctggctcatcctggctcaaaagctcccccactgagcaccttgtgacccccacccctgcccaccagagaacaaccccccttggactgtaattttcctttacctacccaaatcttataaaaccccgctctcccttcactgactctctcttcactgaccacccctctctcccttcactgactctcttttcggactcagcccgcctgcacccaggtgattaaaagcgttattgctcacacaaaacctggtggtctcttcacacggactcaagtgaaa

SEQ ID NO: 349 - DNA, 5710 bp, Homo sapiens
gtcaggcctctgagcccaagccaagccatcgcatcccctgtgacttgcacgtatgcccccagatggcctgaagtaactgaagaatcacaaaagaagtaaaaaggccctgccccaccttaactgatgacattccaccattgtgatttgttcctgccccaccttaactgagtgattaaccctgtgaatttccttctcctggctcagaagctcccccactgagcaccttgtgaccccccgcccctgcccaccagagaacaaccccctttgactgtaattttccattaccttcccaaatcctataaaacggccccacccctatctcccttcgctgactctctttttggactcagcccacctgcacccaggtgaaacaaccagccatgttgctcacacaaagcctgtttggtggtctcttcacacagacgcgcatgaaatttggtggatcaggggacctcccttgggagatcaatcccctgtcctcctgctctttgctccatgagaaagctccacctaccacctcaggtcctcagactgaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcattttctggtagagacaaagaagacacgttttatccgtggacccaaaactccagcactggtcatggactgggaagacagacttcccttggtgtttaatcattgcagagacacctctctgattattcacccacatttcaaaggtgtcagaccacatagggaggcctgccttggtcctccacccttagcggcaagtcccgcttttctgggggaggggcaagtatcccaaccccttctctccatgtctctaccccttctctgcttttctgggggaggggcaagtacccctcaaccccttctccttcacccttagcggcaagtcctgcttttctgggggaggggcaagtaccccaaccccttcttcagtgtctctaccccttctctgcttttctgggggaggggcaagtacccctcaaccccttctccttcacctttagtggcaagtcccgcttttctagggggcaagaacccccaatcccttatttctgtaccccaacctcttatctctgtgccccaatcccttatttccatgccccacccccccttcccacttttctggagggtaagaacccccaaaacccttccctccgtgtctctacaccctcttttctctgggtttgcctccttcactatgggcaaccttccatcctccattcctccttcttctcccttagcctgtgttctcaagaacttaaaacctcttcaactcacacctgacctaaaacctaaatgccttattttcttctgcaatgacgcttaaccccaatacaaactcgacatagttccaaatagccagaaaacggcactttcaatttttccatcctacaagatctaaataattcttgtcgtaaaatgggcaaatggcctgaggtgcctgacgtccaggcattcttttacacatcagtcccttcctagtctctgtgcccagtgcaactcatcccaaatcttccttctttccctcccgcctgtcccctcagtcccaaccccaagcatcgctgagtctttctaatcttccttttctacagacccatctgacctctcccctcctcgccaggccgagctaggtcccaattcttcctcagcctccgctcctctaccctataatctttttatcgcctcccctcctcacacctggtccggcttacagtttcgttccgtgactagccctcccccacctgcccagcaatttattcttaaaaaggtggctggagccaaaggcatagtcaaggttaatgctcctttttctttatcccaaatcagaagcgtttaggctgtttttcatcaaatataaaaatccagcccagttcacggctcgtttggcagcaaccctgagacgctttacagccctagaccctaaaaggtcaaaaggccatcttattctcaatatacattttactacccaatctgctctggacattaaactccaaaaattagaatctggcccccaaaccccacaacagggcttaaataacctcaccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccccaggagcttgctacatgtgccggaaatctggccactgggccaaggaatgcccgcagcctgggattcctcctaagccatgtcccatctgtgtgggaccccactgaaaatcggactgttcaactcacctggcagccactcccagagcccctggaactctggcccaaggctctctgactgactccttcccagatcttctcagcttagcggctgaagactgacactgcctgatcgcctcggaagccccctagaccatcaaggacgccgagcttcaggtaactctcacagtggaaggtaagcccatccccttcttaatcaatacggaggctacccactccacattaccttcttttcaatggcctgtttcccttgcctccataactgttgtgggtattgatggccaggcttctaaacctcttaaaactccccagctctggtgccaacttagataatactcttttaagcattcctttttagttatccccacctgccctgttcccttattaggctgagacactttaactaaattatctgcttccctgactattcctggactacagctatatctcattgccgcccttctccccaatccaaagcctcctttgcgtcctcctcttgtattcccccaccttaaccctcaagtataagatacctctactccctccttggcgaccgatcatgcaccccttaccatctcattaaaacctaatcacccttaccctgctcaatgtcaggatcccatcccacagcatgctttaaaaggattaaagcctgttatcactcacctgctatagcatggccttttaaagcctataaactctccttacaattcccccattttacctgtctaaaaccagacaagccttacaagttagttcaggatctgcgccttatcaaccaaattgttttgcctatccaccccatggtgccaaacccatatactctcctatcctcaatacctccctctactacccattattctgttctggatctcaaacatgcttttttttactattcctttgcacccttcatcccagcctctctttgctttcacttagactgaccctgacaccagttaggctcagcaaattacctgggctgtactgctgcaaggcttcacagacagcccccattacttcaatcaagccaaaatttcatcctcatctgttacctatctcagcataattctcataaaaacacatgtgctctccctgctgatcgtgtccgattaatctcccaaacctcaatcccttacaaagcaactcctttccttcctaggcatggttagcgcggtcagaattcttacacaagagccaggaccgcaccctgtagcctttctgtccaaacaacttgaccttactgttttagcctagccctcatgtctgcgtggagcggctgccgctgctttaatattttttgaggccctaaaaatcacaaactatactcaactcactctctacatttctcataacttccaaaatctattttcttcctcatacctgacgcatgtactttctgctccccggctccttcagctgtactcactctttgttaagtcccacaattaccattgttcctggcccggacttcaatctggcctcccgcattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttaaaacctctcattttctttccatcatagaaatctatcctcaaggaaataacttctcagtgttccatctgctattctactactcctgaaggattattcaggccccctcccttccctacacatcaagctcgaggatttgcccccgcccagtactggcaaattagctttactcaacatgccccgagtcacaaaaactaaaatacctcttagtctaagtagacactttcactagataagtagaggcctttcctacagggtctgagaaggccaccacagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacttcaccaagctcagccaccaacttaaaaaggactggacaatacttttaccactttcccttctcagaagtcagacctgtcctcagaatcctacaaggtacagcccatttaagctcctgtatatacgctcctttttattaggccccagtctcattccagacaccagaccaacttagactgtgccccaaaaaacttgtcatccctactatcttctgtctagtcatactcctattctccgttctcaactactcatacatgccctgctcttgtttacactgccagtttacactgtttctccaagccatcacagctgatatctccttgtgctatccccaaactgccactcttaactcttgaagtaaataaataatctttgctggcaggactatgctgaatctccttaggcactctaatcagatgtcctaggtcctcccaattcttagaccttttccatttagtttttcaattcatacaaaacatatccaggccatcaccaatcattctacacgacaaatgtttcttctaacaaccccacaatatcaccccttaccacaagatcttccattcagcttaatctctcccactctaggttcccacgccgcccctaatcccgcttgaagcagccctgagaaacatcgcccattctctctccataccaccccccaaaaatttttgccgccccaacacttcaacactattttgttttatttttcttattaatataagaaggcaggaatgtctggcctctgagcccaagccaagccatcacgtcccctgtgacttgcacctatatgcccagatggcctgaagtaactgaagaatcacaaaagaagtgaaaaggccctgccccgccttaactgatgacattccaccattgtgatttgttcctgccccaccttaactgagtgattaaccctgtgaatttctttctcctggctcagaagctcccccactgagcaccttgtgacccccccccacctcccctgcccaccagagaacaaccccctttgactgtaattttccattaccttcccaaatcctataaaacggccccacccccatctcccttcgctgactctcttttcggactcagcccacctgcacccaggtgaaataaacagccatgttgctcacacaaagcctgtttggtggtctcttcacatggacgcgcatgaaa

SEQ ID NO: 350 - DNA, 119 bp, Homo sapiens
cgggagggacaatgatcgggatataaacccaggcgttccagggggcaacggcaaccccctttaggtcccctcccatttatgggagctctgttttcactgtattaaatcttgcaattgca

SEQ ID NO: 351 - DNA, 757 bp, Homo sapiens
gtgaggcctctgagcccaagctaagccatcatatcccctgtgacctgcacgtatacatccagatggcctgaagtaactgaagaatcatagaagaagtgaaaatggcctgttcttggccaggcgtggtggctcatgcctgtactcctagcactttgggaggccgaggcgggcagatcacaaggtcaggagatcgagaccatcctggttaacacagtgaagtgaaaccctgcctctactaaaaatacaaaaaaactagccgggcgtggtggcgggtgtctgcagttccagctactcagaaggctgaggcaggagaatggtgtgaacccgggatgcggagcttgtagtgagccaaggttgcgccactgcactccagcctgggcgacagagcgagactccgtctgggggtgggcgggggagaaaggcctgttcctgccttaactgatgacattccaccacaaaagaagtgaaaatggccagtccctgccttaactgatgacattaccttgtgaaattccttctcctggctcatcgtggctcaaaagctcccccactgagcccttgtgacccctgcccctgcctgccagagaacaaccccctttgactgtaattttccactacccacccaaatcttacaaaacggcccccacccctatctcccttcactgactctcctttttcggactcagcccgcctgcacccaggtgaaataaacagccttgttgctcacacaaagcctgtttggtggtctctttacgca

SEQ ID NO: 352 - DNA, 4606 bp, Homo sapiens
gtcaggcctctgagcccaagctaagccattatatcctctgtgacctgcatgtattcatccagacggcctgaagaatcacaaaagaagtgaaaatggcttgttcctgccttaactaatgactttaccttgtgaaattccttctcctggctcagaagctcccctactgagcaactcgtgacccctgtccctgcccaccagagaactacccactttgactgtaatttttcattacctacccaaatcctataaaacaaccccaccccatctcccttcactgactctcttttcagactcagcccacctgcacccaggtgaaataaacagctttgttgctcacataaagtctgtttagtggtctcttcacacggatgtgcatgacatctggtgccatgacccagactgggtaacattccttgggagatcaatcccctgtcctcctgctcttttctccatgagaaagatcaacatacaacctctggtcctcagatcaaccagcccaaggaatatctcaccaattttaaatcgggttaacggcctctttttactctcttctccaacctctctcactatccgtcaacctctttccatttcaatcttggggccacacttcagtctctcccttcccttaatttcagttcctttccttttctggtagagacaaaggagatgtgttttttctgtggacccaaaactctggccctggtcacagacttaggaagacagtcttccctaggtatttaatcatgcggggacacctgcctgattattcacccacatttcattgatgtctgatcaccacagggatgcctgccttggtcatttaaccacattccttttgtggcaagtcagttgtggggatgcctgctttggatgtacacccacaggcagcccagggctgttcactcaccccttctctccacatctctacccatcccttttccacttttctagggggcaagcacctcctgccccttctctccctgtctccaccccttctccactttcctggggggcaggtatcccccacaccttctctctatgtctctatactcttttttctctggacttgcctccttcactatgggcaaacttccaccctccattcctccttcttctcctttagactgtattctcaacaatttaaaacctcttcaactcacacctaacctaaaacctaaatgccttattttcttctgcaatgcctcttgacctcaatacaaacacaatagtggttccaaatagccagaaaatggcactcttgatttttccatcctataagatctaatgagttcttgtcataaaatgggcaaatggtctgaggtgcctgatgtccaggcattctttcacacattggtccctccctagtctctgttcccaatgcaactagtcccaaatcttgcttctttccctcctgcctgtcccctcagtcccaatcccaagtgtcactgagtctttccaatcttcctttctatggacccatctgacctctcccctcctccccaggctgctcctcaccaggccaagccaggtcccaattcttcctcagcctctgctcatgcaccctataatccttttatcacctcccctcctcaaaccctgtctggcttacagttttgttccagtctggctcacagtttctttccacgactagctctcccctacatgactagcactttcctcttaaaaaggtgactggagctaaaggcacagtcaaggttaatgctcctttttctttatctgacttctccaaaatcagttagcatttaggctctttttcatcaaatagaaaaacccagcccagttcatgcctcatttggcagcaacccagagacactttgcagccctagaccctaaaaggtcaaaagactgtcttattcttagtatacattttattactcagtcagctcctgacattaaataaaactccaaaaattaaattccagccctcaaaccccacaacaggacttaattagcctcatcttcaaggtttacaataatagtgtagaggcagccaagtaacaacatatttctgagttgcaattccttgtttccactgtgagacaaaccccagccacatcttcagcacacaagaacttccaaatgcctgaactgcagtggccaagtgttcctccaggaactcctaccccaggatcttgcttcaagtgccagaaatctgtccacagagccaaggaatacctgcagcctgggattcctcctaagctgtgtcacatctgtatgggaggccatcacagaggctttgggtaacactcatagtggagggtaagtctgtacccttcttaatcagtacagagactacccacttcacattaccttcttttcaagggcacgtttccctggtctccataactgttgtgagtattgatggacaggcttctaaacctcttaaaactccccaaatctggtgcaaacttggacaatattcttttatgcactccttcttagttatccccacctgcccagctcccttattaggtcaaacattttaactaaattattggcttccctgactattcctaggctacagccacacctcattgccacattttcccccaattcaaatcctccttcacatcctctccttgtatctacccaccttaatccacaagtataggacacctctacgtccttcttgacaatagatgatgcacccccttaccatcccatgaaaacctaatcaggcttaccccactcaatgccaatatcccatcccacagcatgctttaaaaggattaaagcctgttatcactatcctgttagagcatggccttttaaagcctataaactctccttacaattcccccattttacccgtcctaaaaccagacaagccttacaggttacttcaggatctgttccttatcgaccaaattgttttgcctacccaccccatggtgccaaacccatatactctcctatcctcaatacctccctccacaacccattattctgttctggatctcaaacatgccttcttcactatttgtttgcacccttaaccccagcttctcttcactttcacttggactgacactgacacctatcaggctcagcaaattacctgggctgtactgccacaaggcttcacagacagtccccattacttcagtcaagccagagttcctacctgtgaacacatcctgtatccttttcatctaaacaacttaaccttactcttttagcctagccctcatgtctgtgtgctgcagctgccactgccttaatacttatagaggccctcaaaatcacaaactatgctcaactcactctctactctctacagttctaataacttccaaaatctatttcctgcctcacacctggtgcatctactttctgttacctacccacactacctctcagcaagctgaactcattgccttaacttgagaccttgctcttgcaaaaggactatgcatcaatatttatactgactctaaatatgccttccatatcctgcaccacaaagctgttatatgggaaaaaaaaattcctcactatgcaagtgtcctccatcattaatgcctctttaataaaaacgcttctcaaagctgctttacttccgaaggaagctggagtcattcactgcaagggccatcaaaaggcatcacatcccattgctcagaacaatgcttatgctgataaggtagctaaaagagcagccatccaaaggcatcaggtcccatcactcagcacaatgtttatgctgataaggtagctaaaaagcagctagtattccaacttctatccctaaagcagtttttttccttctcattgttcactcccacctactccccaatgaaacttccaactaccaatctcttcctacacaaggcaaatggttcttggagcaagaatgattccagcctcacaggcccattctattctgtcatcatttcataacctcttccatgtaggatacaagccactagcctgccttttagaacctctcgtttcctttccattgtggaaatctatccttaaggaaataacttctcagtgttccatctgctattctactcctcctcctcagggattgttcaggccccccacattccacttccctacacatcaagctcagggatgtgcccctgcccaggactggcaaattgactttactcacatgccctgagtcagaaaactaaattatctcttgatctgggtagacactttcattggatgggtacaggcatttcccacagatctgaaaaggccacctcggtcatttcttcccttctgtcagacagaattccttggtttggccttccaacctctacacagtctgataacggactggcctatattagccaaatcacccaagcagtttttcaggctcttggtattcactgaaacctttatatcccttactgtcctcattcttcaggaaaggtagaatggactgatggtcttttaaaaacacacctcaccaagctcagccaacaacttaaaaaggactggacaatactttaccgcttgcccttctcagaattccggcctgtcctcggaatgctacagagtatagcccatctgagctcctatatagatgctcctttttattaggccccagtctcattccagacaccagacc

SEQ ID NO: 353 - DNA, 578 bp, Homo sapiens
tcaggcctctgagcctaagctaagccatcgcatcccctgtgacctgcacgtatacgcccagatggcctgaagtaactgaagaatcacaaaagaagtgaaaatggcctgttcctgccttaactgatgacattccaccacaaaagaagtgaaaatgtcctctcctggccttaactgatgacattaccttgtgaaattccttttcctggctcatcctggctcaaagaagctcctccactaagcaccttgtgacccccactcctgccagccagagaataactcccctttgactgtaattttcctttacctacccaaatcttataaaacggccccacccctgtctcccttcactgactctcttttcggactcagcacgcctgcacccaggtgaaataaagatgagttagtgcgtgcagtgcaccagcatgtcacatgtatacatatgtaactaacctgcacattgtgcacatgtaccctaaaacttaaagtataataataaaaaaaaaaaagaaaagaaataaacagccttgttgctcacacaaaggctgtttggtggtctcttcacatgcacgcgagtgaaa

SEQ ID NO: 354 - DNA, 3054 bp, Homo sapiens
gctttgggtaacttacagtggagggtaagtccatccccttcttaatcaatacagaggctaccaagtccatattaccttcttttcaagggcatgtttcccttgcctccataactgttgtgggtattgacggccaggcttctaaatctcttaaaactccccaactctggtgccaacttggacaacattctttaatgcactcctttttagttatccccacctgcccagctcccttatcaggtggagatattttaactaaattatctgctgccctgactattgctgggctatagccacaactcattgctgccttttgtcccagttcaaagccttcttcacatcctctccttgtatatccccaccttaatccacaagtataggatacctctactccctccttggcaatggatgatgcacccgttaccatcccattaaaacctaatcacccttaccccactcaatgccaacatcccatcccacagcatgctttaaatggattaaagcacttgcctgttacagcatggccttttaaagccaataaactctccttacaattccctcattttacctgtccaaaaaccagacaagccttataggttagttcagtatctgtgccttatcaaccaaattgtcttgcctgtccactccatggtgtcaaaaccatatactctcctatcctcaatgcctccttccacaacccctccataacccattattctgttctggatatcaaacatgctttctttattgttccattgcaccttttatcccagcctctctttgctttcacttgcactgaccctgacacccatcagcctcagcaacttacctgggctgtactgccgcaaggcttcgcggacagcccccattacttcagtcaaacccaaatttctccctcatctgttacctatctcagcataattcctcatgaaaacacatgtgctctccctgttgattgtgtctggctaatctcccaaacccaaccccttctacaaaacaacaactcttttccttcctaggcatggttaggtacttccgcctttggatacctagttttaccatcctgactaaaccattatgtaaactcacaaaagcaaacctagctgaccccatagatcctaaatccttttgccgctcctctttctgttccttaaaaacagccccagaagctgccccaatgctggctttccctaactcatcccaacccttttcattacacacaggcaaggtacagggctgtgcggtcaaaattcttacacaagagccaggaccatgccctgtaggctttctgttcatacaacttgaccttactgttttaggctggcccccaccccagtgactatatctctctgatccacctgacattcactccatttccctgtagttccttctttcatgttcctcaccctgatcacacttggtttattgatggcagttccaccaggcctaatctccactcaccagcaaaggcaggctatgctagagtatcttccacatctatcattgaggctaccactctgcccccctccattacctctcagcaagctgaactcattgccttaacttgagccctcactcttgcaaaggaattttgtgtcaatatttatagtgactctaaatatgccttccatatcctgcaccaccttgctgttatatgggctgaaagaggtttcctcactatgcaagggtcctccatcattaatgcctctttaataaaaactcttctgaaggccactttacttccaaaggaagctggagtcatacactgcaagggccaccaaaaggcatcagatcctatcactgagggcaacgcttatgctgataaggtagctaaagaagcagccagcattccaacttccatccttcatggccagtttttctccttctaattggtcactcctatttactctcctactgaagtttccacctatcaatctcttcccacacaaggcaaatggttcttggaccaaggaaaatacctccttccagcctcacaggcccattctattctgtcatcatttcataacctcttccatgtaggttacacactgttagctcctctcttaaaacctctcatttcctttccatcatgaatatctatccccagtcctccactcttgactccctcttggagtggatagatgatctttgctgacaggacacactccaacactttcaccctgatgaagtcctattctttacttttatactcactcttattctcattcccattcttatgccaccctctacctctcctcagctatctccaccacactatcaatctcactcactctctcctagccatttctaatccttctttaacaaacaattgctggctttgcatttctctttcctccaaaatcactgaggcctcaatttactcactgctgaaaaaggaggattctgtgtatttttaaattaagaatgttgtttttacctaaatcaatctggcctggcatatgacaacataaaaaaactcaaggatataaaaactcaccaaaaaaccgcccaaaactcaccaaccaaacaaataattatgctgaacacccttgggcactctctaattggatgtcctgggtcctcccaattcttagtcctttaatacctgtttttcttcttctcttattcagaccttgtgtctttcgtttagtttctcaattcatacaaaaccgcatccaggccatcaccaataattctatacaacaaatgcttcttctgacaactccacaatatcactccttaccccaaaatctttcttcagtttaatctctcctactctaggttcccacaccgcccctaatcccacttgaagcagccctgagaaacatcacctattatctctccataccacccccccaaatttttgctgccccaacacttcaccactattttgttttgtttttcttattaatatatgaagacagaaatgtcaggcctctgagcacaagctaagccatcatatcccctgtgaactgcgtgtatacatccagatggcttgaagcaactgaagatccacaaaagaagtgaaaatagccttaactgatgacattccaccat

SEQ ID NO: 355 - DNA, 7767 bp, Homo sapiens
gtaggagatcaatcagagtggtgggaaaaattgcagaaagatgcaaacctttttggaaggctgggaggttttacaaaagctttgggaaaggatttggctgaaggcagccagattctcttacctggtgcctgaaagcttaggttagataacaaggggatgtaaagaaactgagctagataagttagcttacttaggccttggaacctggcctttaatcatccgtgcacaggactgctctctctggggtgggggtgacccacaagtgtgttgactcaggcctttgtcattgaatctgtactgaataaatgcctgcagtgccagtgggtcagggctgctgctgctgactctttacagcatcctccttggggtctgtaaatggcccggtcccctagcccactctttcactggatacctgtgtctgagtgcattctttcatccatcacttggccagggtctgtgggttggacccggcaggtggtgccccgtgtgaggaacaccacaacagatcacgatggaacccttgaaaacgaaggtgaagagactgtgcagtcagtaagtcattggtgcctgcttgggatttccaagttcaagggaattgttcaggctagagtttcatcatgggacaacagttatcggctcaaaagcaacagtatataaaagtattgaaacagctgcttaaagctagtggagcctcggttttgcaggctcaattaagggacctaatgcaaactgttgtttcccataacccatggttcctagaagaaggtatgctagacatagtgctctgggaacaagtggggagaaatcttaaacaacatcatgcgcaagggcaacgggtcccagtaacatctctaatgttataggctttaattagggtggctctggttccgctttacacagaagagcctaaaaagggaagggaggaggaacagtcacctactttactgcctccttatccctcagcctgctaccaccgggccaaaataacaaagaggaaacggaggttttgcctaagccccgtcctccaataaattggaaaaaagacaagggatacgttacagctatgggaccctgcattaggcaagcggcattagaagggaagctcttagcctgcccagtaatgcaagatcgacaaggcaatcaggtacatgaacccatttcttttaacgcttacaaagagctatgaaaaagcattaaataaaatggagctgctagcccatttatgaaaggaatgattgaagccatggcagacaacttctgtatgaccccatggactggtcagtgctagctaaaacgactttggagcccagccaatacattctctggagagcagaatatgatgagttgtgtcaacagtaagccaaccagaaccaggttgccaggcaagacataacagctgctatgctccaggggtggggcccccatgtcgatgtacaacaacaactaacttttgatccccaggtctatgcacaagtgtttttgtgcactgtcagggcttgggactgaattcccaaaagcggagttcaacagggatcttttataaatgtttgacaagggcctcaggagccatttgttgagtttatcaattggttaacccagacaattaagagacaaattagtcatgcccaggctgctgatatcttattgttgcaattgacttatgaaaatgctaatgtggattgcctgcaagaaatgcaggcactcagaggaaaggcagccacagttggagaatttatatgagcatgtcaactggtggggactgaaacacacaaagccaaaatattggctatggtattaaggcctcctaaagtgaaaagggagagaaacccaaattgttttctatgtggagagccaggtcatatgaagagagaatgcctcaataatagagaccaaggtaactcaggaaaagaatccccttctatatttccccgatgtaacaaggggaaacaatgggcaaatcaaggcaggtccaaatttgataaaaacggcaaccctataagtaaccaggtgggaaacttcatgagggggctggccccaggccccgcttcaaactggggtaatgccagtggctttcctcggtcagatggaaagcccacagtcctctctctcagagcagccaccgctggaagcgcaggactggacttactctgccccgacgaattaatgctaaaagaaggagaagaccctaaaagggtttgcaactgggatctggggcccactgcctctgggaacagtgggattagtcccagagcgatcgcgcctatccagtaaaggaattaatgtgctcaatggggtaactgatagtaattatcaaggtcagatattacttacgatggaatgtaaaggtctgcatattcttcccccggatcaaagatagaacagttactgctttcaccatactgggttcccaacgcccacagaaaggaaaggggaaagggaacttatggaagtacaggagccataggaaaatattggaatcaattaatcactgatcagagacccatgattaccttaaaattggaaataaaaattttactggcttattggacacaggggtggacatttcgattattagtgatgaaaactggccagaaacttggccttgggtcactcaaaaaattgggtcacaaacaaaaaattgtcggcatcagggaagcatacacagctaagcagagcatgtgccccctaacctgttgcgattcagagggaagaaaggcagttatacaacctctaattatgcccatccctgttaatctttgaggatgagatctattagcccagtgcggggggtcactctgcagtcccttttctaataatggccactgttattatccctccggtacccctgacatggctctctcaagatccaatttgggtacaacagtggcctttaaagggacagaaattacaaagagcctatgaattagttgaggagcaattaaaaaccggccatatagaaccatcaaacagcccttggaattcacccatttttgtcattcccaaaaagtctggtaaatggagacttttgcatgacttacgtgccatcaatgctcatttgcaacctatggggcaccttcagcaggggctcccctcccctgtggagattcctcgagattggcctataatcattattgacttaaaagactgcttttatactattccccttgcaaagcaggacagaaaatttgtgtttacaataccagctatcaataatgaaaggccaactcgctgatttcattggaaagtgcttcctcaaaggatgctaaacagtcctactatgtgtcaagatcatgtaaatcaggctttgctccccagtagaaaaaaatttcctaattgcaaggttattcattttatggatgatattttactagtagccccaacagagccagtacttgtaaatttacatgcctctgtcataaagaatacacagttaagaggtttaatcatagcacatgaaaaagtatagatgtcttctccttggaaatatcttggatacatactaacttcttggtcagtaagacctcaaaaagcaacttatacaccttaaatgattatcagaaattaccaggtgatattaactgctttcaccccaccttaggcataactactgataagttacagaacctgttttctatcttaaaacgcaatgctgccctagactctcctaggtatttaactcctgcggcacaaagggaaattgaagagatagagcaagctatttctcagaggcaactagatcgcatagatccatggtactcagttcaattgtttgtttccactaaacgttcctctacagggttaataggacagatgaccccagggctgtgcttcctagaaagggttttttgctcgtataccgggactaaaacactctttccctatatccagttcgtcagtaaagtcatctattcaggctgcagatgacgcaatcagttgctaggttatgaccctgatatcatcaggattcctttaagtaaaaagcaattcaaagcagtattgcctttatctatggacgtgcaaatagcactctctgattacacaggccaaatagagcatgccctacctgctgacaaactccttcaattcttatctcacacttctgtggttttgcctactaaaatagttcaatcccccatacctaacactttaacactgtttactgatggctctggtaaacatggaaaagcggctgtttggtggattctgcataattccctcacttggtctggatttactagcactcagagagctgaggttggagctttaatactggccttggaaactttttccgctcagcccgtcaatattgttagtgagtctgtttactctgtttgtttattgcagaatcttgagacagccctcattaagtccacattggagcccatcctgtgtgcactctttctccaacttcagcatttgctagatcaacatacacatcctatttttatcacacatattcgagcctacagctcactgcctggtccattggcatatggcaatgatcaagcagacctatcagttatgacatcactgcttgaccaagccacccaattgcatcaatttttccaccaaaactgaagaaacttatctaaacaatttcaacttacccagagactaaacaaattatcctgcaatgcccagattgccagctcagtcacgtcccctccttccacaggtgttaaccctacaggactagaaccttatcagttacggcaaacagacgttacacacatccgtgaatttggaaaacttagatatgtacatgtatccgttgataccaattctcacttaattagcacttatgcctttcctggagagtccacccattatgtcattaaacatcttcttttaacttttgcatttatggggcagcccacaaaaattaaaactgataatggtccggcttatgccagctcacaatttcaacaattttgtcacacgtggaacatccaacattccaaaggcatcccgtataaccctaaatacaggccatagaacgtacccactccacccttaaaaatatgctcagaaaacaaaataggaggaatatgagtaagggccctgcaatactattggcacaagcttatttacccttaatttttaaaatttaaatgataaatttcaatcagctgtagaaaagcactttgctaaaacctctcaagacataaaacctgctgttttatggaaagatgtaaacagtaatgtatggtgtggtccaagtgaattgttaatgtagggaagaggatatgcttgtgttcacaccccctcaggtcctctttggattccagcacaatgcatcaaaccataccatggcatgggtaggacccaacccggtaccagaaatgaagaaaatgaccctacaggacccacagccccagatgatgtggcttccttggataactaaagcctcagacattacctgggggatgctgaagaagacaacttaggaggctgaacgaatcctgctccggacacagacaccattcactccagataatgtgttccttgctatgctctctgttgtacactgcaactcatgtagggtattgatcctttttatgctcttgctttgtccgcaacctgtacctgctatactctgttggactcatatcttagatctgcctttcttcgccctgtcacctgggcagacaccccctttccaccctctaaaaccataactgcttggctgggagggacagatttacccccagtggggtccctcattaatagcacacattggactaaagtgcctggtaacactacatatcactccactatcctgccactgtgtgtagttacaaaagttctaacccttacccttactgtgtacctgccccaaatacaattatggctacatcatggcaaaggaaatgccttaacattcttagctgcaggtagccttaaaccgggcaacgcaatcaatgccactttcccaaacattcctcccagtgctaaagaacaaagcctggaaagtaatggattccactttagctgggaggtctgtcatgggggacaagcccatagcttctagttaggcaattgtaacatcttagactggagcccccacagccatttgcagggcgatcatactgatgtccgcgtctatcatggcatcaatgacagttttgaagccacttcccgttcccctataatttgggctgataggaaaatgtgacatcccagacctcaagtaaagtccataccacctgaagacactttatggtgcctgggacatcttagcaccccccttaacacctggcatgggacatatcaaaattccagtcacaattatactatgatgttttttcataatcacactgatcagtgcttgacttgcactacccatgcatatgttttcccttatgggaaccaatatttctattacactccaaaactccacatttgtgacccgagtgcagggacaggcttggtttgcctctgtatctctaattataatatatctaatttaaatattaccagcatcatggtattgaggagacaatctgaggcttttctgccagtcaatttaatatatgattggcaaagttcctctacccttgccaacttagaacgtgccctgtcccagttcagacacaaaagattcatagttacacttatagcctttatagtctcagccatagtcatcctagcaatgctagcgtggctgtagcatctattactgaatcaatacaaacagctacttttatagataatttggcagaaatgtgtctaatgaacttctcttacagcagggtatagatcaaaagattcttgcatgtctgcaagccctcgaggctgccttggaagatgtgggggagtgacaagatgcactggtattctgacagcaattaaactgtgactgggagcataaggataactgtgtcacttctctaccttggaatcaatcaatacatagttgggatgaggtgaaaccacctctggagaacctttcatgacaatttaacagcagacataaagcaactcaaaactaaaattctagaatccctaaatgccatagatctacatgcccaacaaacagccatatggaagggtgtgcgagatcatctctcctggaaagacccccgttcctgggggccactccttcattggaaaagaacgttgctaattatactcatgtttgcttatgttatttactaattctaggatgcaaagccagaatatgagcaatgaccaccacgcctgacaaacctgttcctgcacaaatctgtactcttcaatcaacaaaacctgatgcaaaaaacagaaaaagggggagatgtaggagatcggtcagggtggtgggaaaaattgtagaaagatgcaaaccttcttgaaaggctgggaggttttacaaaagctttgggaaaggatttggctgaaggcagccagattctctaatccagtgcctgaaagcttaggttagataacaaggggatgtaaagaaactgctctagataagttagtttacttaggcctcggaacctggcctttaatcatctgcacacaggactgctctctctgagttgggggttggggggtggggggatgacccacaagtgtgttgactcaggcctttgtcattgaatctgtactgaataaatgcctgcagcaccagtgggtcagggccacggctgctgactctttacagcaccctcctcagggtctgtaaacggccaggtctcctagcccgctctttcactggatacttgtgtctgagtgtattctttcatccatcgttcagccagggtctgcaggtcggacctggca

SEQ ID NO: 356 - DNA, 302 bp, Homo sapiens
tgggtcaggcacaaagtaagcctatcccactaggaactatgatgaaaaatttcaagaaaggatttaagggagattacggtgttactatgacaccaggaaaacttagaaatttgtgtgaaatagactggtcagcattagaggtgggttggccatcagaaggaagcctggacaggtcccttgtttcaaaggtatggcacaaggtaacctgtaagccagtgcacccaggccagttcccatacatagacacttggttacagctggttttagacacccccccaacagtggctgagagaatagcagca

SEQ ID NO: 357 - DNA, 5784 bp, Homo sapiens
gtcagacttctgagcccaagctaagccatcatatcccctgtgacctgcacgtacacatccagatcgctggttcctgccttaactgatgacattccaccacaaaagaagtgaaaatggcctgttcctgccttaactgatgacattgtcatgtgaaattccttctcctggctcatcccagctcaaaagctcctccactgagtaccttgtgaccccccactcctgcctgccagagaacaacacccctttttcctttacctacccaaatcctataaaacggccccacccctatctcccttcactgactcttttcggactcagcctgcctgcacccaggtgaaataaacagccacgttgctcacacaaagcctgtttggtggtctcttcacatggatgcgcatgaaatttggtgccgtgactcagatcgggggacctcccttgggagatcaatcccctgtcctcctgctttttgctccatgagaaatgtccacctacgacctcaggtcctcagaccgaccagcccaaggaacatctcaccaatttcaaatccggtaagaggcctctttttactctcttctccaacctccctcactatccctcaacctctttctcctttcagtcttggcaccacacttaatctctcccttctcttaatttcaattcctttcattttctggtagagacaaaggagacacattttatccatggacccaaaactccggcaccagtcatggactgggaaggcagccttcccttggtgtttaatcattgcagggacgcctctctgattattcacccatgtttcagaggtgtcagaccacgcagggatgcctgctttagtccttcacccttagcggcaagtcccgcttttctgtgggaggggcaagtaccccaaccccttctctccatgtctctaccccttctctgcctttctggggggcaagaaacccccaaccccttctccttcacccttagcagcaagtcctgcttttctaggggagggtcaagtaccacaaccccttatatctctgtgccccgatcccttatttccacaccccaacctcttatatctctgtgccccgatcccttatttccacaccccaacctcttatatctctgtgccccgatcccttatttctgcaccccaacctcttatatctctgtgccccaatcccttatttccacgccccaacctcttatatctctgtaccccaatcccttatttccacaccctgatgtcgtatctctgtgccccaaccccttctctgcttttctggagggcaagaataccccaccctttctctgtgtctctactgttttctctgggcttgcctccttcactatgggcaagcttccaccttgcccattcctccttcttctcccttagcctgtgttcttaagaacttaaaacctcttcaactctcacctgacctaaaatctaagcatttgattttcttctgcaatgccgcttgactccaatacaaactcgacagtagttccaaataaccggaaaacggcactttcaatttttccatcctacaagatctaaataattcttgtcataaaatgggcaaatggtctgaggtgcctgacatccaggcattcttttacacatcggtccctccctagtctctgtgcccaatggaactcgtcccaaatcttccttctttccctcccgcctgtcccctcagtcccaaccccaagcgtcactgagtctttctaatcttccttttctacagacccatctgacctctcccctcctccccaacctgctcctcgccaggccgagctaggtcccaattcttcctcagcctccgctcctccaccctataatccttttatcacctcccctcctcacacccggtctggtttacagtttcattccgtgagtagccctcccccacctgcccagcaatttcctcttaaaaaggtggctgaagctaaaggtatagtcaaggttaatgctcctttttctttattagacctctcccaaatcagtgagcatttaggctctttcatcaaatatgaaaaactcagcccagttcatggctcatttggcagcaaccctgagacactttacagccctagaccctaaaaggtcaaaaggccgtcttattctcaaaatacattttatcacctaatctgctcccgacattaaataaaactccaaaaattaaattccagccctcaaaccccacaacaggatttaattaaccttgccttcaaggtgtacaataatagaaaaaagttgcaattccttgcctccactgtgagaaaaaccccagccacatctccagcacacaagaacttccaaatgcctgaaccgcagcagccagaacctcctcccccaggagcttgctacaagtgccagaaatctggccaccaggccaaggaatgcctgctgcccaggattcctcctaagccgcgtcccatctgtgcaggaccccactggaaatcggactgtccaactcacctggcagccactcccagagcccctggaactctggcccaaggctctctgagtccttcccagatcttcttggctcagcggctgaagattgacactgcccgatcacctcggaagccccctagaccatcacggacgccgagctttgggtaactctcacagtggaaggtaagtccgtccccttagtcaatacggagggcacccactccacattaccttcttttcaagggcctgtttcccttgcctccataactgttgtgggtattgatggccaggcttctaaatccctgaaaactccccaactctggtgccaacttggacaacactcttttatgcactcttttttagttatccccacctgcccagttcccttattaggctgagatattttaaccaaattatctgcttccctgactattcctggactacagccgcatctcattgccacccttctccccaacccaaagcctccttcgcgtcttcctctcgtatccccccaccttaacccacaagtatgggacatctctactccttccctggcaaccgatcacatgcccattaccatcccattaaaacctaattacccttaccccgctcaatgccaatatcccatcccacagcacgctttaaaaggattaaagcctgttatcactcgcctgctacagcatgggcttctaaaacctataaactctccttacaattcccccattttacctgtctaaaaaccggacaagtcttacagattagttcaggatctgcgccttatcaaccaaattgttttgccatccatcctgtggtgcccaacccatacactcttttgtcctcaataccttcctccacaactcactattccgttctcgatcttaaagatgcttttttcactattcccctgcacccctcttcccagcctctctttgctttcacttagactgaccccgacacccattaggctcagcaaattacctgggctgtactgccgcaaagcttcacagacagcccccattacttcagtcaagctgaaatttcttccttatctgttacctatctcagcataattctcataaaaacacacgtgctttccctgctgatcgtgtccgattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcatagccatcatgtctccgtgcagtggctgctgccgccctaatacttttagaggccctcaaaatcacaaactatgctcaacttactctctacatttcttataacttccaaaatctattttcttcctcatacctgatgcatatactttctgctccccggctccttcagctgtactcactctttgttaagtcccacaattaccatagttcctggcccggacttcaatccggcctcccacattattctggataccacacctgaccctcatgactgcatctctctgatccacctgacattcaccccatttctccatatttccttctttcctgttcctcaccctgatcacgcttgatttattaatggcagttccaccaggcctaatcgccacacaccagcaaaggcaggctatgctatagtacaagccactagcctgcctcttagaacctctcattttctttccatcgtggaaatctatcctcaaggaaataacttctcagtgttccatctgctattctgctactcctcagggattattcaggctccctcccttccctacacatcaagctcaaggatttgcccccacccaggactggcaaattagctttactcaacatgcgagtcagataactaaaatacctcttagtctaggtagacactttcactggataagtagagtcctttcctacaaggtctgagaaggccaccgcagtcacttctttccttctgtcagacataattcctcagtttagccttcccacctctatacagtctgataacagaccagcctttattagtcaaatcagccaagcagtttttgaggctcttagtattcagtgaaacctttatatcccttacagtcctcagtcttcaggaaaagtagaacggactaaaggtcttttaaaaacacacctcaccaagctcagccaccaacttaaaaaggactggacaatacttttaccactttctcttctcagaagtcagacctgtcctcagaatgctacagggtacagcccatttgagctcctgtatagatgctcctttttattaggccccagtctcattgcagacactagaccaacttagactgtgcccccaaaaaacttgtcatccctactatcttctgtctagtcatactcctattcaccgttctgaactactcatacatgccctgctcttgtttacactgccggtttacactgtttctccaagccatcacagctgatatctcctggtgctatccccaaactgccactcttaactcttaaagtaaataaataatctttgctggcaggactatgctgaatcttcttaggcgctctctaatcagatgtcctgaatcgtcccaattcttagacctcttatacctgtttttctccttctcttattccatttagtttttcaattcgtacaaaactgtatccaggtcatcaccaataattctaaattacaaatgttccttataacaaccccacgatatcaccccttaccacaaaatcttccttcagcttaatctctcccactctaggttcccacactgcccctaatcctgctggaagcagccctgagaaacatcacccattatctctccataccacccccaaaaattttcaccatcctaacactttaccactatttcattttatttttcttattaatataagaagacaggaatgtcaggccgctgagcccaagctaagccatcatatcccctgtgacctgcacgtacacatccatatccccggttcctgccttaactgatgacattccaccacaaaagaagtgaaaatggcctgttcctgccttaactgatgacattgtcttgtgaaattccttctcctggctcatcctggctcaaaagctcccccactcagtaccttgtgatcccccactcctgcctgccagagaacaacccccctttttcctttacctacccaaatcctataaaacggccccacccctatctccctttgctgactctcttttcggactcagcccacctgcacccaggtgaaataaacagccatgttggttgctcacacaaagcctgtttggtggtctcttcacacagatgcgcatgaaa

SEQ ID NO: 358 - DNA, 237 bp, Homo sapiens
gccttaactgatgacattatcgtgtgaaattccttctcctggctcatcctggctcaaaagatcccctactgagtaccttgtgacccccactcctgcccgccagagaacaaccccctttgactataattttcctttacctacccaaatcttataaaacggccccacccctatctcccttcgctgaatctcagcccgcctgcacctaggtgaaataaacagccttgttgctcaaaaaaa

SEQ ID NO: 359 - DNA, 365 bp, Homo sapiens
gtcaggcctctggacccaaacctgcacgtatacatctagatggcctgaagtaactgaacaatgacaaaagaagtgaaaatggccggttcctgccttaactgatggcattaccttgtgaaattccttctcctggctcagaagctcccccactgagcaccttgtgtcccccgcccctgcccgccagggaacaaccctctttgactgtaattttccactacctacccaaatcctataaaacggtccatcactatctcccttcgctgactctcttttcggactcagcccgtctgcccccagatgattaaaaagctttatcactcacacaaagcctgtttggtggtctcttcacacggatgtgtgtgaaa

SEQ ID NO: 360 - DNA, 87 bp, Homo sapiens
gacttggatacgttccgtagtggtaagacacctctatcccttgccttctttggctggaggcatttcacccctgtgtgtggtttcctt

SEQ ID NO: 361 - DNA, 6412 bp, Homo sapiens
gacagacaggactagctggatttcctaggccaactaagaatccctaagcctagctgggaaggtgaccgcatccacctttaaacacggggcttgcaacttagctcacacccaaccaatcagagagctcactaaaatgctaattaggcaaaaacaggaggcaaagaaatagccaatcatctattgcctgagagcacagtgggagggacaaggatcgggatacaaacccaggcgttcaagctggcaacagcaaccctctttgggtcccctctctttgtgtgggagctctgttttcactctatttcactctattaaatcttgtaactgcactcttctggtccatgtttgttatggctcgagctgagctttcgctcgccatccaccactgctgtttgccgccatcgcagacccgccaccgcagacctgccactgcagacccaccactgactcccatccctccggatccagcagggtgtccgctgtgctcctgatccagcgaggtgtccattgccactcccaatcaggctaaaggcttgccattgttcctgcacagctaagtgcctgggttcatcctaatcaagctgaacactagtcactgggttccacggttctcttccgtgacccatgtcttctaatagagctataacactcaccgcatggcccaagattccattccttggaatccgtgaggccaagaaccccaggtaagagaacacgaggcttgccaccatcttggaagtggcctgccaccattgtggaagtggcccacaaccatcttgggagctctggaagcaaggacccccggtaacattttggtgaccacgaagggacatccaaagcggtgagtaatattggaccactttcgcttgttattctgtcctatccttccttagaattggaggaaaatactgggcacctgtcagccagttaaaaacgattagcgtggccgccggacttaagactcaggtgttacgctatctgcggaagggctttctaacaacccccaacccttctgggttggggacgttggtctgcttggagccagcttccactttcaattttcttggggaatccgagggctgactagaggcagaaagctgtcgtccagaactcccggcattagcctgttgagatcatggcgcagccagaagtctctactcaacagtcgcccatgggtgcgcccctacctttccttctgacccatacctcatgggtcctgaccacgactttcttgaaagtgtagccccaaaattctccttacctttgaatctacttcctctgatccctgcctcctaggtactaatggttcacactttcatttcctctagcaagttgtatctccaaagggatctagggaggctctgcgttgtgtccttaggcacctgggctgtaacccagggagtcttatccctggtgtccctcctgattcaggtatgcagctctcgacatgggcagttatgtgggacccgttccccactacccttgccagggccccaagtttgtaatggctgagagagagagagacggagagagagggagagacggagagagagacaaagacagagtcaaagagaaaaagaaagaaaaagatagaataaaaaaaaaaagtgtgccctattcctttaaaagccagcgtaaatttaaaacctgtaattgataattgaaggtcttctctatgactctataatactccaataccactgttgtcaatgtaaataagggcgtagcccaaaagcactgaggccactggcaacctgtagctttcctataaaaaatccttaacccagtaacccgcggatgggccaaatgcattcagtcggtagcggcaactgctttgctaaaagtagaaaagtaacttttagaggaaaccttcttgtgagcacacctcaccagttacattattctaagttaaaaaaaaagcaaaaaggtagcttactaaatcaaaaatcttaaagtatggggctattatgttagaaaagggtaatgtaactccaaccactgataattcacttaacccagcagatttcctaacaaaggatttaaatcttaattaccatacaaaggtccgaccagacctaggaggaactcccttcaggacaggacgatagatggttcctcccaggtgattgagggaaaaaaccacaataggtattcagtaattaatacagagactctgtggaagcagagttagaaaaattgcctaataattggtctcctcaaacgtgcgagctgtttgcactcagccaagcccatacttacataatcaaaagactatttcaatcctgactcaaaaggttcgctacacctctctgaaacgaatttgcataagagtgttgtttatgggaatgcatcttgatggggcagctgggttgttatgaaatacccaggaacccagcccagctctaggactcacccctgagcgcaaaagcaatgtcgggcacgctggtaaaggaccactagaatccagcagcccagacccctttctttgtggtcaagagaggtggaaaaataggtgcaggactgctacattggtgagcgtaactaatccgataagcagaggtccatgggtggttacgcaccctggaaaagaataagcattaggcccttagaggatgctttaggactaatgctcatcggaaaatgactaggggtgctggcatccctatgttcttttttcagatcggaaacgttccccacaccccaaggcaaaaacgcccttaagatgtattctggagaataaggaccaatttgaccctcagacgctaagaaagaaatgacttatattcttctgcagtactgcctggccatgatatcctcttcaagggggagaaacctggcctcttgagggaagtataaattataacaccatcttacagcttgacctcttctgtagaaaggagggcaaatggagtgaagtgccatatgtgcaaacttccttttcattaagagacaactcgcaattatgtaaaaagtgtggtttatgccctacaggaagccctcagagtctgcctccctatctcagcatccccccgactccttctgcaactaataagggaccccccttttacccaaaggtccaaagaagatagacaaagggataaacaatgaaccaaacagtgccaatattccccgattatgccccctccaagcaatgtgaggagcagaattcggcccagccagagtgcatgtacctttttctctctcagacttaaagcaaattaaaatagacctaggtaaattctcagataaccctgatggctatactgaagttttataagggttaggacaatcttttgatctgatgtggagagatataatgttactgctaaatcagacactaaccccaaatgagagaagtgtcgccataactgcagcccgaagagtttggtgatctctggtatctcagtcaggtcaatgataggatgacaacagaggaaagagaacaattccccacaggccagcaggcagttcccagtgtagaccctcattgggacacagaatcagaacatggaaattggtgccgcagacatttgctaacttgtgtgctaggactaaggaaaactaggaagaagcctatgaattatgcaatgatgtccactataacacagggaaaggaagaaaatcctactgcctttctggtgagactaagggaggcattgaggaagcatacctctctgtcacctgactctattgaaggccaactaatcttaaaggataagtttatcactcagtcaactgcagacattagaaaaaaacttcaaaagtccgccttaggcccagagcaaaacttagaccctattgaacttggcaacctcggttttttataatacagatcaggagaagcaggcggaatgggacaaacgggataaaaaaaaaggccactgctttagtcatggccctcaggcaagcggactttggagtctctggaaaagggaaaagctgggcaaatcgaatgcctaatatggcttgcttccagtgtggtctacaaggacactttaaaaaagattgtccaagtagaagtaagctgccccctcgtccatgccccttatgtcaagggaatcactggaaggcccattgccccaggggacgaaggtcctctgagtcagaagccactaaccagatgatccagcagcaggactgagggtgcccggggcaagcaccagcccatgccatcaccctcacagggccccgggtatgcttgaacattgaaggccaggaggttaactgtctcctggacactggcatggccttctcagtcttactctcctgtcccagacaactgtcctccagatctgtcactatccgaggggtcctaggacagccactaagttgtgactggggaactttactcttttcacatgcttttctaattatgcctgaaagccccactcccttgttagggggagacattctagcaaaagcaggggccattatatatctgaacataggagaaggaacacctgtttgttttcccctgcttgaggaaggaattaatcctgacgtctgggcaacagaaggacaatatggatgagcaaagaatgcctgtcctattcaagttaaattaaaggattctacctcctttccctaccaaaggcagtacccttagacctgaggcccaacaaggactccaaaagattgttaaggacttaaaagcccaaggcctagtaaaaccatgcaatagcccctgcaatactccagttttaggagtacagaaacctaatggacagtggaggttagtgcaagatctcaggattatcaatgaggctgttcttcctctataccctgctatacctaacccttgtactctgctttcccaaaaaccacagaaagcagagtggtttacagtcctggaccttaaggatgcctttttctgcatccctgtacaccctgactctcaattcttgtttgcctttgaagatcctttgaacccaatgtctcaactcacctggactgttttaccccaagggttcaagcatagcgcccatctatttggccaggcattagcccaagacttgagccaattctcatacctggacactcttgtccttcagtacggggatgatttaattttagccacccgatcagaaacctggtgccatcaagccacccaagcactcttaaatttccttgctacctgtggctacaaggtttccaaacaaaatgctcagctctgctcacagcaggttaaaaacttagggctaaaattatccaaaggcacaagggccctcagtgaggaacgtatccagcctatactggcttatcctcatcccaaaaccctaaagcaactaagagggttccttggcataacaagcttctgccgaatatggattcccaggtacagcgaaatagtcaggccattatacacactaaggaaactcagaaagccaatacccatttagtaagatggacacctgaagcagaagtggcttttcaggccctaaagaaggccctaacccaagccccagtggtaagcttgccaatggggcaagacttttctttatatgtcgcaaaagaaacaggaatagctctaggagtccttatacaggtccgagggaccagcttgcaacctgtggcatacctgagtaaggaaattgatgtactggcaaagggttggcctcattgtttacgggtagtggcaacagtagcagtcttagtatctgaagcagttaaagtaatacagggaagagatcttactgtgtgaacatctcatgatgtgaatggcatactcactgctaaaggagacttgtggctgtcagacaaccgtttacttaaatatcaggctctattacttgatgggccagtggtgtgactgcgcacttgtgcaactcttaacacagccacatttcttccagacaatgaagaaaagatagaacataaatgccaacatgtgattgctcaaacctaatgctgctcaaggggaccttttaggggttcccttgactgatcccaacctcaacttgtatactgatggaagttcctttgcagaaaaaggactttgaaaagcggggtatgcagtggtcagtgataatggaatacttgaaactaatcccctcactccaggaactagtgctcagcatgcagaactaatagccctcactcgggcactagaattaggagaagggaaaagggtaaatatatatacagactctaagtacgcttacctagtcctccatgcccatgcagcaatatggagagaggggaattcctaacttccgagggaacacctatcaaacatcaggaagccattaggagattactattggctgtacagaaacctaaagaggtggcagtcttacactgccagagtcaccagaaaggaaagggaaacagaaaggaactgccaagcggatattgaagccaaaagagcggcaaggcaggaccctctattagaaatgcttatagaaggacccccagt

SEQ ID NO: 362 - DNA, 2606 bp, Homo sapiens
ccactactactgctgccctcctacccccaaacttgcctagttcataagacaggaggaaagagagaaagcaaaaagttagaaagaaacaaaagtaagataaatagccagacaaccttggcaccaccacgtggccctaggagttaaaataataataataataataataacatcaacccctgacctaaactacttgtgttatctttaaattccagacattgtatgaaaaagcattgcaaaactttctgttctgttagctgatccatgtagcccccagtcacgtttcccacacttgctcgatttatcacgaccctttcacatggaccccttaaagttgtaagcctttaaacaggccaagaatttctttttcggggggctccgctcttaagccacaagtctgccagtgcttccggccgaataaacctctttcttctttaatccggtgtctgaggagttttgtctgcagctcgtcctgctacatttcttggttccctgactgagaagcgaggtgattaagggacgttcaagccagccccttaggcagcttatgcctgccctgtagagcatccctgtggggggctccagccagcttgcgcgatgcagatcctgagagtgctcccgggtaggcatttgcccccgtggaatgcctcgtcagagtggtgcatggcaagcccccgtggaggatcaacgcagtggctgaacactgggaaggaactagcactttaagtctggacatttgaaacttggtaagactggtctttggaacttgcacactccatttgagtggaagcgtggcctgatcacccatggcgtgcctgtaccggcactttggtttttgtttttgacttgacttgaaatgcttgatactttggtttttgtttttgacttgacttgaattacttgataaacaggcgtgcctttattggcactttggctttggttctgattttgacttggcttaaattccttgacaaacaggtgtgcctttaatgacactttggttttagttttgattttcctttagtgtgaattagacgagtgagtaaccttttaccctttccttcttgtagtgtgaatgttgttttgtctcaagagaaaaataggtcaaacacaaagtaagcccactccgctagaaactgtgttaaaaaaaaatttcaagaagaaaaataaaaggaaagtcatctaatcatcaaaacttactctattaaaatgcatgttacagaaccttaagaaaggttttgcaggggattacagaggttaagcccccagaggttaagaactctatgtgaattagaattgccctcttttgctgggcgcggtggctcacgcctataatcccagcactttgggaggccgaggcgggcagatcacgaggtcaggagattgagaccatcctgactaatagggtgaaaccccatctctactaaaaatacaaaaacaaaaaattagccaggcgtgctggcgggcacctgtagtcccagctactcaagaggctgaggcaggagaattgcatgaacctggcaggcggagcttgcagtgagtggagattgtgccactgcactccagcctgggcaacagagcgagactccgtctcaaaaaaaagaaaaaaaaaaaagaattgccctcttttggtgttggatggcccaccgaaggaactacagacagggaacaattggccatgtatttaaggtggtgacaggggttggaggacagccagtggacctagatcaattcctttatattgattcatggttaaatataatatagacaaaaaccagcataaatttagccctgtttaacagcttattgcaaaaaagccaaaagtgaaagtaagaacagctgcaccagcagacacagagttgaaaaggggagtcccagaaagagcaagagaagccagttttgcaggagccgccagagataacagaaattctttctccatatggcccagcctacccccctttaccgaggccaacagccccctgagaaacgagattaaggagctaacatgccccaggtctcaccttgaaggggaagatcggagcctcaagaggccaaggaaggaagtcaagatagtcaagtgggccctctcagatctggtcttgctggagctatgcaaatgcctctcagggagacacgaggacctgtctattataatgaccaagcccacatccagggggtggggcaacagactttcatctatcagccctttttaaccattgatctactaaactggaaacaccctgaacccgccaccttgttcccagcagctagagccctgtcgagcattaactgtgtagaggtgttggactcaagtttactctagcagacctgacctccgagaccagccttgggcatcagtagactgggagctatacatggacgggagcagcttcatcaacccacaaggagagagatgtgcaggatatgcagtgataaccctggacactgtcgttaagctgagctcattgctttaattcaggccttagaactcagtgaaggtaagactaaacatttacactgactctcagtatgcctgtttaaccctccaactgcatggagaattatatttaaaaaagggcctgttaagatctaggaaaaaggggaaaaaa

SEQ ID NO: 363 - DNA, 724 bp, Homo sapiens
ttaccgaaggtagttggtcagacatacgcagggcaggagagagcgcccctggcccctacaaccccaaccagaaatatcaggcaacaatcactgatggtcaagcagtggttaaactgtttctctaaaataataattggttgcagccagtgccagggaaaagcagtatccccaatagatagaaacatctgaaactcatgatcagcagcttccgataacatctcaggagctgggcaagtgggttcaagcatgcacactaagaggcaaaatggtggagtttaactggtctatgactcctcctagggacatctggtaagagaagaatgcctcaagtgagtatgtacacaactctagtaaacacacagcacatgtggaaccccctctccctgtaagtgctggcagccactgtgcatgcggacagcccaccccaagggaagaatcaggagagaagggacacgaggccctggaagtatgccaacatataaaaccctaagtcaaaggtcgaactgtgctcttgaatccctcaagtcacccacttggccctcttccaagtgtactttacttcctttcattcctgctctaaaactttttaataaactcactcctgctctaaaacttgcctcactgtctccctctgccttatgccccttagctgaattctttcttctgaggaggcaagaattgaggctgctgtagacccatgtggatttgccactgctgaacaata

SEQ ID NO: 364 - DNA, 784 bp, Homo sapiens
gagagacaggactagctggatttcctaggccagctaagaattcctaagcctaggtggggaaggcgaccgcacccacctttaaacatggggcttgtaactcagctcacacccgaccaatcaggtagtaaagagcgttcactaaaataccaattaggctaaaagcgggaggtaaagaaatagtcaatcatctattgcctgagagcaaagggggagggacaatgatcggcatataaacccaggcatttgagccggcagtggcaaacccctttgggtcccctcccattgtatgggagctctgttttcactctattaaatctcgcaactgcacactcttctggtctgtgtttgttccggcttgagctgagctttcactcacagtccaccactgctgattgcctccgttgcagacccgccgctaatttccacctctccggatccggcagagtgtccgctgcacttctgatccagggaggcacccactgacgctccccatcgggctagaggctcgccattgttcctgcgcagctaagtgcccgggttcgtcctaatggagccgaacactagtcgctgggttccacggttctcttccgtgacccacagcttctcatagagctataacactcatgcatggcccaaggttccattccttggaatccgtgaggccaagaaccccaggtcagagaacaaaaggcttgccaccatcttgagagcagcccaccaccatcttggaagcagcccgccaccatcttagaagctctaagaacgaagacccgccggtaacact

SEQ ID NO: 365 - DNA, 5749 bp, Homo sapiens
gtcaggcctctgagcccaagccaagccatcgcatcccctgtgacttgcacgtatacgcccagatggcctgaagtaactgaagaatcacaaaagaagtgaaaagaccctgccctgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccacccctatctccctttgctgactctcttttcggactcatccggcctgcacccaggtgaaataaacagccatgttgctcacacaaagcctgtttggtggtctcttcacacggacgcgcatgaaatttggtgccatgactcagatcaggggacctcccttgggagatcaatcccctgtcctcctgttctttgctccgtgagaaagatgcacctacgacctcaggtcctcagaccgaccagcccaaggaacatatcaccaattttaaatcaggtaagcggtctcttcttactctcttctccaacgtctctcactgtccctcaaccactttctcctttccactcttcaatctctcccttctcttaatttcaattcctttcattttctgggagagacaaaggagacacgttttatccgtggacccaaaactccggcggcggtcacggactgggaaggtagccttcccttggtgtttaatcattgcagggacgcctctgattattcacccacgtttcaaaggtgtcagaccacgcacggacgcctgccttggtccttcacccttggcggcaagtctcgcttttctggggaaggggcaagtaccccaaccccttctctccttgtctctaccccttctctgctttcctggggcaggggcaagtacccctcaacctcttcttcacccttagctgctagtcccgctttcctagggggcaagaaccccccaatcgcttatttccacgccccaacctcttatctctgtgccacaatcgcttatttccgcgccccaacctcttatctctgcgccccaattgcttatttccgcgccccaacctcatctctgcgccccaatcccttatttccgcgccccaacctcttatctctgtgccccaatcccttatttccgtgccccaacactttctctgcttttctggagggcaagaaacccccaccccttctgcgtgtctctactcttttctctgggcttgcctccttcgctatgggcaagcttccaccttccattcctccttcttctcccttagcctgtattcttaagaacttaaaacctcttcaattctcacctgacctaaaatctaagcgcctcattttcttctgcaacaccgcttgaccccaatacaaactcgacagtagttccaaatagccggaaaacagcactttcaatttttccatcctacaagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccttcctccccagcctgctccttgccaggccaagctaggtcccaattcttcctcagcctctgctcctccaccctataatctttttatcgcctcccctcacacctgatccggcttacagtttcgttccgtgactagccctcccccacctgcccagcaatttactcttaaaaaggtggctggagagctaaaggcatagtcaaggttaatgctcctttttctttatcccaaatcagatagcgtttaggctctttttcatcaaatataaaaatccagcccagttcatgacttgtttggcagcgaccctgagacgctttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggtgtgcaataacagaaaaaagttgcaattccttgcctccactgtgagacaatccccagtcacatctccagcacacaagaacttccaaacgcaaccaggcgttcctccggaacctcctcccccaggagcttgctacacgcgccggaaatctggccactgggccaaggaatgcccgcagcccgggattcctcctaagccgcgtcccatctgtgcgggaccccactgaaaatcggactgttcaactcacctggcagccactcccagagcccctggaactctggctcaaggttctctgactgactccttcttgacttaccggctgaagactgatgctgcctgatcgcctcagaagccccgtagaccatcacggatgccgagctttaggtaactctcacggtggagggtaagtccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacatctatatctcattgccgcccttcttcccaatccaaagcctcctttgcgtcctcctcttgtatccccccaccttagcccacaagtataagatacctctactccctccttggcgaccgatcgtgcaccccttaccatctcattaaaacctaatcacccttaccccactcaacgccaatatcccatcccgcagcacgctttaaaaggattaaagcctgttatcactcgcctgctacagcatggccttttaaagcctataaactctccttacaattcccctattttacctgtcctaaaaccagacaagccttacaagttagttcaggatctgcaccgtatcaaccaaattgttttgcctatcccccctgtggggcccaacccgtacactcttttgtcctcaatacctccctccacaactcactattccgtgcttgatcgtaaagatgctttcttcactattcccctgcacccctcgtcccagcctctctttgctttcacttagactgaccctgacacccattaggctcagcaaattacctaggctgtactactgcaagacttcatagacagcccccattacttcagtcaagcccaaatttcatcctcatctgttacctatctcggcataattctcataaaaacacacgtgctttccctgctgatcgtgtccgattaatctcccaaacctcaatcccttacaaaataacaactcctttccttcctaggcatggttagtgcggtcagaattcttacacaagagccaggactgcgtcctgcagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattaccattgttcctggccgggacttcaatctggcctcccacattattcctgataccacacctgacccccatgactgtatctctctgatccacctgatactcaccccatttccccatatttccttctttcctgttcctcaccctgatcacgcttgattttttgatggcagttccaccaggcctaatcgccacacaccagcaaagccaggctatgctatagtacaagccactagcccacctctcagaacctctcatttcctttccatcgtggaaatctatcctcaaggaaataacttctcagtgtttcatctgctattctactactcctcagggattattcaggccccctcccttccctacacatcaagctccaggatttgcccccacccaggactggcaaattagctttactcaacatgcccgagtcaggaaactaaaatacctcttagtctaaatagacactttcactgaataagtaaaggcgtttcctacagggtctgagaaggccaccacagtcatttcttcccttctgtcagacataattcctcagtttagccttcccacctctatacagtctgatagcagaccagcctttattagtcaaatcagccaattagtttttcaggctcttagtattcagtgaaacctttatatcccttacggtcctctatcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagatgctcctttttattaggccccagtctcattccagacaccagaccaacttagactgtgcccccaaaaaaaacttgtcatccctactatcttctgtctagtcatactcctattctccgttctcaactactcatacatgccctgctcttgtttacactgccagtttacactgtttctccaagccatcacagctgatatctcctcgtgctatccccaaactgccacttttaactcttgaagtaaataaataatctttgctggcaggactatgctgaatctccttaggcactctctaatcagatgtcctaggtcctcccaattcttagaccttttatacctgtttttctccttcttattccatttagtttttcaattcatacaaaaccatatccaggccgtcaccaatcattctacacaacaaatgtttcttctaacatccccacaatatcaccccttaccacgagacctcccttcagcttaatctctcccactctaggttcccacgccgcccctaatcccactcgaagcagccctgagaaacatcgcccattctctctccataccaccccccaaaaattttcgtcgccccaacacttcaacactattttgttttatttttcttattaatataagaaggcaggaatgtcaggcctctgagcccaagccaagccatcgcatcccctgtgacttgcgcgtatacgcccagatggcctgaagtaactgaagaatcacaaaagaagtgaaaaggccctgccccgccttaactgatgacattccaccattgtgatttgttcctgccccaccttaactgagtgattaaccctgtaaatttccttcttctggctcagaagctcccgcactgagcaccttgtgacccccgcccctgcccaccagagaacaaccccctttgcatgtaattttccattaccttcccaaatcctataaaacggccccatccctactccctttgctgactctcttttcggactcatccggcctgcacccaggtgaaataaacagccatgttgctcacacaaagcctgtttagtggtctcttcacacagacgcgcatgaaa

SEQ ID NO: 366 - DNA, 5738 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgtcttgtgaaattccttctcccggctcatcccggctcagaagatcccctactgagcaccttgtgaccccccactcctgcccgccagagaacaacccccctttgactgtaattttcctttacctacccaaatcttataaaacggccccaccccatctctcttcactgactctttttggactcagcccgcctgcacccaggtgattaaaagctttattgctcacataaagcctgtttggtggtctcttcacacagacgtgcatgaaatttggtgccatgactcgcattgggggacctcccttgggagatcaatcccctgttctccggctctttgctccctgagaaagatccacctacggcctcaggtcctcagaccaaccagcccaagaaacatctcaccaatttcaaatcaggtaagcggcctcttcttattcccttctccaacgtctctcactatccctcaaccactttctcctttccactcttcaatctctcccttctcttaatttcaatttctttcattttctggtagagataaaggagacacattttatccgtggatccaaaactccggcgccagtcacggactgggaaggcagccttcccttggtgtttaatcattgcagggatgcctctctgatcattcacccaagtttcagaggtgtcagatcacacagggatgcctgccttggtccttcacccttagcggcaagtcccgcttttctgggggaagcgaaagtaccccaaccctttctctccatgtctctaccccttctccacctttctggggggcaagaaacccccaaccccttcttcacccttagcagcaagtcccgcttttctggaggaggggccagtaccccaacctcatatatctgtgccccaacctcttatatctctgcgccccaatcccttatttccatgcgccaacctcttatatctctgcgccccgatcccttatttccacaccccaacctcttatatctctgtgccccaatcccttatttctgtgccctgacctcatatctctgtgccccaaccccttctctgcttttctggagggcaagaaccccccaccccttctccgtgtctctactcttttctctcggcttgcctccttcactatgggcaagcttccatcttccatttctccttcttctcccttagcctgtgttcttaagaacttaaaacctcttcaactctcacctgacctaaaatctaagagtcttattttcttctgcaatgccgcttgaccccaatacgaactcgacagtagttccaaatagccagaaaatggcactttcaacttttccatcctacaagatctaaataattcttgtcataaaatgggcaaatggtctacggtgcctgatgtccaggcattcctttacatatcagtccctctctagtctctgttcccagtgcaactcatcccaaatcttccttctttccctcccacctgtcccctcagtcccaaccccaagcgtcactgagtctttctaatcttcctttctacagattaggggtcagacacatctgacctctcccctcctccccaggctgctcctcgccaggccaagctaggtcccaattcttcctcagcctccgcttctccaccctataatccttttatcccctcccctcctcacacctggtctggcttacagtttcgttccatgactagccctcccccacctgcccagcaatttactcttaaaaaggtggctggagctaaaggcatagtcaaggttaatgttcctttttctttatcccaaatcagatagcatttaggctctttttcatcaaatataaaaatccagcccagttcatgacttgtttggcaacaaccctgagacactttacagtcctagaccctaaaaggtcaaaaggccatcttattctcaaaatacattacccaatctgctcctgacattaaataaaactccaaaaattaaattccggccctcaaaccccacaacaggatttagttaacctcagcttcaaggtgtacaataatagaaacaagttgcaattccttgtctccactgtgagacaaaccccagccatatctccagcacacaagaacttccaaaggcctgaaccgcagcggccaggcgtggcattcctccagaacctcctcccccaggagcttgctacaagtgccagaaatctggccaccaggccaaggaatgcccgcagcccgggattcctcctaagctgcatcccatctgtgtgggaccccactggaaatcggactgtccaactcacctggcagccacgccactcccagagcccctggaactctggcccaaggctctcagactccttcccagatcttcttggcttagcggctgaagattgacgctgctcaagcgcctcggaagccccctagaccatcacggatgccgagcttcaggtaactctcacagtggaaggtaagtccgtccccttcttaatcaatatggaggctacccactccacattaccttcttttcaagggcctgtttcccttgcctccataactgttgtgggtattaacagccaggcttctaaacctcttaaaactccccaactctggtgccaatttagacaatactcttttgagcactccttttagttatccccacctgcccagttcctttattaggccgagacactttaactaaattatctgcttccctgactattcctggattacagctatatctcattgctgcccttcttcccaatccaaagcctcctttgcatcctcctcttgtattcccccaccttaacccacaacaataagatacctctactccctccttggtgaccaatcatgcaccccttaccatctcattaaaacctaatcacccttaccctgctcaatgccaatatcccatcccacagcatgctttgaaaggattaaagcctgttatcactcacctgctatagcatggccttttaaagcctataaactctccttacaattcccccattttacctgtcctaaaaccagacaagccttacaagttagttcaggatctatgccttatcaaccaaattgttttgcctatccaccccatggtgccaaacccatatactctcctatcctcaatacctccctccacaatccattattctgttctggatctcaaacatgctttctttactattcctttgcacccatcatcccagcctctcttcgttttcacttggactgaccctgacacccatcaggctcagcaaattacctgggctgtactgccgcaaggcttcacagacagcccccattacttcagtcaagcccaaatttcatcctcatctgttacctatcttggcataattctcataaaaacacacgtgctttccctgctgatcatgtctgattaatctcccaaacctcaatcccttacaaaacaacaactcctttccttcctaggcatggttagtgtggtcagaaatcttacacaagagccaggaccgcaccctgtagcctttctgtgcaaacaacttgaccttactgttttagcctagccctcatgtctgcctgcagcggctgctgctgttttaatacttttagaggccctaaaaatcacaaactatgctcaactcactctctacatttctcataacttccaaaatctattttcttcctcatacctgacgcatatactttctgctccccggctccttcagctgtactcactctttattaagtcccacaattaccattgttcctggcccggacttcaatctggcctcccacattattcctgataccacacctgacccccatgactgtatctctctgatccacctgatattcaccccatttccacatatttccttctttcctgttcctcaccctgatcacgctttatttattgatggcagttccaccaggcctaatcgccacacaccagcaaaggcaggctatgctatagtacaagtcactagcccgcctcttagaacctctcatttcctttccaccgtagaaatctatcctcaaggaaataacttctcagtgttccatctgctattctactactcctcagggattattcaggccccctcccttccctacacatcaagctcaaggatttgcccccatccaggactggcaaattagctttactcaacatgccccgagtcagataactaaaatacctcttagtctaggtagacactttcactggataggtacaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagtattcagtgaaacctttatattccttatggtcctccgtcttcaggaaaagtagaacggactaaaggtcttttaaaaacacaccttcccaagctcagccaccaacttaaaaaggactggacaatacttttaccactttcccttctcagaagtcagacctgtcctcagaatgctacaaggtactgcccatttgagctcctgtatagacattcctttttattaggccccagtctcattccagacgccagaccaacttagactgtgccccaaaaaaacttgtcatccctactaacttctgtctagtcatactcctattcaccattctcaactactcatacatgccctgctcttgtttacactgccggtttacgctgtttctccaagccatcacagctgatatctcctggtgctatccccaaactgccactcttaactcctgaagtaaataaataatctttgctggcaggactatgctgaatctccttaggcactctctaatcagatgtcctgggtcatcccaattcttagaccttttatacctgtttttctccttctgttattccatttagtttttcaattcatacaaaactgtatccaggccattaccaataattctacatgacaaatgtttcttctaacaaccccacaatgtcaccccttaccacaaaatcttccttcagcttaatctctcccactctaggttcccacaccacccctaatcccgctcgaagcagccctaagaaacatcgcccactatctctccatactatcccccaaaattttcactatcccaacactttaccactatttcgttttatttttcttattaatataagaagacaggaatgtcaggcctctgagcccaagctaagccatcatatcccctgtgacctgcacgtacacaaccagatggccggttcctgccttaactgatgacattccaccacaaaagaaatgaaaatggcctgttcctgccttaactgataacattgtcttgtgaaattccttctcccggctcatcctggctcaaaagctcccctactgagcaccttgtgacccccactcctgcccgccagagaacaacccccctttgactgtaattttcctttacctactcaaatcttataaaacggccacacccctatctctcttcactgactctcttttcggactcagcctgcctgcacccaggtgattaaaagctttattgctcacacaaagcctgtttggtggtctcttcacacggatgcccatgaaa

SEQ ID NO: 367 - DNA, 3490 bp, Homo sapiens
gtcaggcctctgagcccaagctaagccatcatatcccctgtgaccttcatgtacacatccagatggccggttcctgccttaactgatgacattatcttgtgaaattccttctccttgctcatcctggctcaaaagctcccctactgagcaccttgtgacccccactcctgcctgccagagaacaacccccctttttcctttacctacccaaatcctataaaatggccccaccccatctcccttcactgactctctttttggactcagcccacctgaacccaggtgaaataaacagctttattgctcacacaaagcctgtttggtggtctcttcacatggatgcatgtgaaatttggtgctgtgactcggattgggggacctcccttgggagatcaatcccctgtcctcctgctctttgctctgtgagaaagatccacctacgacctcaggtcctcagactgaccagcccaagaaacatctcaccaatttcaaatctgggaagcagcttctttttactctcttctccaacttccctcactatccttcaacctctttctcctttcaatcttggcaccacacttcaatttctcccttctcttaatttcaattcctttcattttccggtagagaccaaggagacacgttttatctgtggacccaaaactccggtgccggtcgcggactagggaaggcagccttcccttggtgtttaatcattgcagggacgcctctctgattattcacccaggtttcagaggtgtcataccacgcagggacacctgccttggtccttcacccttagcagcaagtcctgcttttctgggggaggcacaggaaacccaccctcttatctctgcaccccgatcccttatttccatgccccgccctcttatctctgtgccctgatcccttatttccacaacctgacctcctatctctgcaccccaaccctttatttctgtgccccaacccatttcctgcttttctggaaggcaagaccaccccaccccttctctttgtgtctctactctctcttttctctaggcttgcctccttcactatgggcaagcttccactctccattcccctttcttctccattagcctgtgttcttcaaaacctaaaacctcttcaactcacacctgacctaaaacctaaatgccttattttcttctacaatgccgcttgaccccaatacaaactcaacagtggttccaaatagccagaaaatggcactttcaatttttccatcctacaagatctagataattcttgtcataaatgggcaaatggtctgaggcgcctcacgtccaggcattcttttacacatcggtccctccctagtctctgttcccaaagcaactcatcccaaatcttctttctttccctcccacctctcccctcagtcccaaccccaagtgtctctgagtctttctaatcttccttttctacagacccatctgacctctccccttcttgccaggctgagctaggtcccaattcttcctcagcctctgctcctccaccctataatccttttatcacctcctctccttacactgggtctggcttacagtttcattccatgactagccctccccaacctgcccagcaatttactcttaaaaaggtggctggagctaaaggcatagtcaaggttaatgctcctttttctttatcccaaatcagataaggtttaggctcttttgcatcaaatataaaaatccgccccagttcatggctcgtttggcagcaaccctgagacgctttacagccctagaccctaaaaggtcaaaaggccgtcttattctcaatatacattttattacccaatctgctcccgacattaaataaaattccaaaaattaaattccggccctcaaaccccataacaggacttaattaacctcgccttcaaggtgtacaataatagagtacaggcagccaagtagcaacatatttctcagttgcaattccttgcctccactgtgagacaaaccccagccacatctccagcacacaagagcttccaaacgcctaaagcgcagtggccaggcgttcctccagaatcgcctctcccaggagcttgctacaagtgccagaaatctgaccaccaggccaaggaatgcctgcagcccgggattcctcctaagccatgtcccatctgtgcgggaccccactagaaatcggactgttcagctcacctggcagccactcccagagcccctggaactccagcccaaggctctctgactgactccttcccagatcttcttggcttagcagctgcagaccgacactgcccaatcgatcgcctcggaagcctacaggaccatcacagacgctctaggttactctcacagtggagtgtaagtccatccccttcttaatcaatacagaggctacccactccacattaccttcttttcaagggcctctttcccttgcctccataactgttgtgggtattgacagccagtcttctaaacctcttaaagctccccaactctggtgccaacttagacaatactcttttaagcactcctttttagttatccccacctgcccagttcccttattaggccgagacacttcaactaaattatctgcttccctgactattcccggactacagatacatctcattgccacccaccttaacccagaagtagaagatacctctactccctccttggcgacctatcatgcaccccttaccatctcagtaaaacctaatcatccttaccccgctcaatgccaatatctcatcccacagcatgctttgaaaggattaaagcctgttaccactcacctgctacagcatggccttttaaagcctataaactctccttacaattcccccatcttacctgtcctaaaaccagacaagccttacaagttagttcaggatctatgacttatcaatcaaattgttttgcctatccaccccaaggtgccaaacacatatactctcatatcctcaattcctccctccacaacccattattctgttctggatctcaaacatgctttctttactattcctttacacccttcatcccagccactcttcgctttcacttggactgaccctgacacccatcaggctcagcaaattacctgggctgtactgctgcaaagcttcacagacagcccccattacttcagtcaagcccaaatttcttccttatctgttacctatctccgcataattctcataaaaacacacgtgctctccctgccgatcgtgtgtgactaatctctcaaaccccaaccccttctacaaaacaacaactcctttccttcctgggcatggttggatactttcatctttagatatctggttttgccatcctaacaaaaccattatataaactcacaaaaggaaacctagctgaccccatagatcctaaatcctttcctcactcctctttctgttccttgaagacagctttaaagactgcccccatcctagtcttggttccctgac

SEQ ID NO: 368 - DNA, 5556 bp, Homo sapiens
gtcaggcctctgagcccaagctgagccatcatacacctgtgacctgcatatacacatccagatggccggttcctgccttaactgatgacattgtcttgtgaaattccttctcctggctcatcctggctcaaaagctcccctactgagcaccttgtgacccccactctgcccgccagagaacaaccccgctttgactgtaattttcctttatctacccaaatcctataaaacagccccacccttatctccctttgctgactctctttttggactcagcccacctgcacccagatgattaaaagctttattgctcacacaaagcctgtttggtggtctcttaacatggccgcgcatgaaatttggtgccgtgactcggatcgggggacctcccttgggagatcaatcccctgtcctcctgctctttgttccatgaaaaagatccacctatgacctggggtcctcagatccaccagcccaaggaacatctcactaattttaaatcaggtaagcggcctctgtttactctcttctccaacctccctcactatccctcaacctctttctcctttcaatcttggtgccacacttcaatctctcccttctcttaatttcaattcctttcattttctggtagagacagaggagacaggttttatccgtggacccaaaactccggcgccggtcacggactagggaaggcagccttcccttggtgtttaatcattgcagggacacctctctgattattcaccgaggtttcagaggtgtcagaccatgcagggatgcctgccttggtccttcacccttagtggcaagtcccgcttttctgggggagggccaagtaccccaaccccttctctccatgtctctaccccttctccacttttctggggcaggggcaagaacccctcaaccccttctctttcactcttagtggcaagtcccacttttctaggggacaagaacccccaatcccttatttccacgccccgacctcttatctctgcgtcccaaccccttatttctgcaccctgacccctttcccgctttcctggaaggtaagaacctatgaaccccttccctccatgtctctactctctcttttctctgggcttacctccttcactatgggcaaccttccaccctccattcctccttcttctcccttagcctgtgttctcgagaacttaaaacctcttcaactcacacctgacctaaaacctaaatgccttatcttctgcaatgctgcttgaccccaatataaactcgacagtggttccaaatagccagaaaatggcattttcaatttttccatgctacaagatctaaataattcttgtcataaaatgggcaaacggtctgaggtgcctgacatccaggcattcttttatacattgttccctccctagtccctgttcccaatgcgactcatcccagatcctccttctttccctcccacctgtcccctcagtcccaaccccaagcatcgctgagtctttctaatcttccttttctacagacccatctgacctctccccttctcgccaggctgagccaggtcccaattcttcctcagcctctgctcccccaccctataatccttttatcacctcccctcctcacaccgggtccagcttacagtttcgttctgcaactagccttcccccacctgcccagcaatttcctcctaaaaaggtggctggagctaaaggcatagtctttgacctctcccaaaatcagttagcatttaggctctttttcatcacatataaaaacccagcccagttcatggctcatttggcagcaaccctgagacgctttacagccctagaccctgaaaggtcagaaggccgtcttattctcaatatgcattttattacccaatctgctcccgacatgaaataaagctccaaaaattaaattccggccctcaaaccccacaacaggacttaattaacctcaccttcaaggtgtacaataacagagtagaggcagccaagtagcaatgtatttctgagttgcaattccttgcctccactgtgagacaaaccccagccacatctccagcacacaagaactccaaacgcctgaaccgcagctgccaggggttcctccagaaacttcccccaggagcttgctacaagtgccagaaatctggccactgggacaaggaatgcccacagctcgggattcctcctaagctgcgtcccatctgtgtgggaccccactgaaaatcggactgttcaactcacctggcagccacttccagagcccctggaactctggcccaaggctctctgactccttcccagatcttctcagcttagcagctgaagactgacactgcctgatcgcctcagaagcctacaggaccatcacagatgctctagataactctcacagtggagggtaagtccgtccccttcttagtcaatatggaggctacccactccacattaccttcttttcaaggtcctgtttcccttgcctccataactgttgtgggtattgacggccaggcttctaaacctcttaaaactccccaactctggtgccaacttagaaaacattcttttatgcactcttttttagttatccccacctgcccagttcccttattaggccaagacattttaactaaattatctgcttccctgactattcctggactacagctgcatctcattgccgcccttctccccaacccgaagcctcctttgcatcttcctctcgtatcccccaaccttaacccacaagtatgggacatctctactccctccctggcaaccgatcacatgcccattaccatcccattaaaacctaatcacccttaccccactcaatgccaatatcccatcccacagcatgctttaaaaggattaaaacctgttatcactttcctgttacagcatggccttttgaagcctatatactcttcttaccattcccccattttacctgtcctgaaaccagacaaggcttacaggttagttcagaatctgcgccttatcaaccaaattgttttgcctatccaccccttggtgccaaacccatatactctcctatcctcaatacctgcctctacaacccattattctgttctggttctcaaacatgctttctttactattcctttgcacccttcatcccagcctctctttgctttcacttacactgaccctggcacccattaggctcagcaaattacctgggttgtactgccgcaagtcttcacagacagcccccattacttcagacaagcccaaatttcatcctcatctgttacctatctcggcataattctcataaaaacacacgtgctctccctgctgattgtgtccgattaatctcccaaacctcaatcccttacaaaacaactcctttccttcctaggcatggttagtgcagtcagaattcttacacaagagccaggactgcaccctgtagcctttctgtccaaaagacttgactttactgtttagcctagccctcatgtctgtgtgcagcggctgccgctgctttaatacttttagaggccctaaaaatcacaaactatgctcaactcactctctacatttctcataacttccaaaatctattttcttcctcatacctgacgcatacactttctgctccccggctccttcagctatactcactctttgttaagtcccacaattaccattattcctggtccggacttcaatctggcctcccacattattcctgataccacacctgacccccatgactgtatctctctgatccacctgacattcaccccatttccccatatttccttctttcctgttcctcaccctgatcacacttgatttattgatggcagttccaccaggcctaatcaacacacaccagcaaaggcaggttatactatagtacaagccactagcctgcctcttagaacctctcatttcctttccatcatggaaatctatcctcaaggaaataacttctcagtgttccatctgctattctactgctccgcagggattattcagggcccctcccttccctacacatcaagctcaaggatttgcccccacccaggactggcaaattagctttactcaacatgccccgagacataactaaaatacctcttagtctaggtagacactttcactggataagtagaggcctttcctacagggtctgagaaggctaccgcagtcatttcttcccttctgtcagacataattcctcagtttaaccttcccacctctatacagtctgataacagaccagcctttattagtcaaatcagccaagcattttttcaggctcttagtattcagtgaaacctttatgtcaattacagtcccaagtcttcaggaaaagtagaacagactaatagtcttaaaaacacacctcaccaagctcagccaccaacttaaaaaagactggacaatacttttaccactttcccttctcagaagtcagagctgtcctcagaatgctacaagggacagcccatttaagctcctgtatagatgctcctttttattaggtcccagtctcattccagacaccagagcaacttagactgtgcccccaaaaaacttgtcatccctactatcttctgtctagtcatactcctattcaccattctcaactactcacacatgccctgcttttgtttacactgccagtttacactgtttctctaagccatcacagctgatatctcctggtgctatccccaaactgccactctaaactcttgaagtaaataaataatctttgctggcaggactatgctgaatctccttaggcactctctaatcaggtgtcctgggtcctcccaattcttaggccttttatacctgtttttctccttctcttattccatttagtttttcaattcatacaaaaccatatccaggccatcaccaataattctacacgacaaatatttcttctaacaaccccacaatatcaccccttaccacaaaatcttccttcagcttaatctctcccactctaggttcccacgccgcccctaatcccgctcgaagcagccctgagaaatatcgcccattatctctccacaccaccccccaaaattttcaccatcccaacactttaccactatttcattttatttttcttattaatataagaagacaggaatgtcaggcctctgagcccaagctaaaccatcatatccctgtgacctgcacgtacacatccagatggcccgtttctgccttaactgatgacattccaccacaaaagaagtgaaaatggcctgttcctgccttaactgatgacattttcttgtgaaattcctggctcatcctggctcaaaagctcccctactgagcaccttgtgaccccccactctgccctccagagaacaaccccccttgactgtaattttcctttatctacccaaatcctataaaatggccccacccttatctcccttcgctgactctttttggactcagcccacctgcacccaggtgattaaaagctttattgctcacacaaagcctttttggtggtctcttaatacggacgacgcgcatgaaa

SEQ ID NO: 369 - DNA, 9377 bp, Homo sapiens
tttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcaaggcggggactgagagccagcccctcttcccccactggcttaggacgcccatcggggatcctaagatccttaggaaccacctggaggactgtgggtatgaggtgttcaagaagaaagctcaaatcttccgacggcaggtaccttgcgtgggatttacaataagacatgggtccgaacgcagctcgggaacagaaagaaagcaggttatttgcaatctaccggagcttaagggcagaaggcaggtgagagaattcttaggagctgtggggttttgtagactgtggatcccaaactttgcagtattagccaagcctttgtatgaggtcacaaagggggcggggacccggaaactttgaaatggggatcccgacaacagcgagtctttcattagttaaaggaaaaacttctggcagccccagccctggggctacccgatctgacaaagccttttccattgtatgcgtcagagagagaaaagatggcagctggacttttaacccaaactgtggggccctggctgaggccggtagcctacgtctctaaacaactagacaggtttctaaaggatggcccccctattagagggccttggcagcaactgccctgctagtacaagaagcaaataagctgattcttgggcaaaacctgaacataaaggccccccattttgtgatggctgagatccatcccctcttaccccctggctcttgggactcccatcgcagtggggggaggcaccccccgcgaggcggggactcagagccaacccctcttccccccctggctcttgggaccactatcgcagggggcgaggcaatccccgcgaggcggggactgcgaacctccccctttcctcccctggctctttgcaccctcatcacaggggaggaggcacccctcgcgacgcggggactgagagcgagcccctcttcccccctttgctcttaggacccccatcgctgggggcggaggcaccccccgcgaggcagggactgagagccagtccctcttccccccctggctctggggacccccatcgcaggagggggaggcacccaccgcaagggtggggactgagagttatcccctcttccacccccggctgttgctaccctcatcgcagggggggggaggcaccccccgcgaggcagggactgagagccagcccctggttcccccactggctcttaggacccccatcgcagaggggggaggcaccccccgcgaggcagggactgagagccagaccctcatccccccctggcttaggaccccccatcgttgctcctaagatccttaggacccacctggaggactgtgggtgttagttgtccaagtagaaagttcaaatcttccgacagcaggtaccttacgtgggattactgagagccagaccctcttccccccctggctctgaggacccccatcgcaggagggggaggcaaccctcacgagagtggggactgagagctatcccctcttccacccctggctcttagtacccccatcgcagggggggaggcaccccccgcgaggcagggactgagagccagtccctcttcccccccctggctcttaggacccccatcgcaggagggggaggcaccccccgcgagggtggggactgagagttatcccctcttccacccccggctgttgctaccctcatcgcagggggggggaggcaccccccgcgaggcagggactgagagccagcccctggttcccccactggctcttaggacccccatcgcagaggggggaggcaccccccgcgaggcggggactgagagccagaccctcttccccccctggcttaggaccccccatcgttgctcctaagatccttaggacccacctggaggactgtgggttttaggtgtccaagtagaacgttcaaatcttccgacggcaggtaccttacatgggatttacgatcagacgggtccgaacgcagctcgggaacagaaagaaagcaggttatttgcaatctaccggagcttaagggcagaaggcaggtgagagaattcttaggagctgtggggttttgtagactgtggatcccaaactttgcagtattagccaagcctttgtatgaggtcacaaaggggtcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaaggacggcctccctatttgagggctttggcagcaactgccctgctagtacaagaagcaaataagctgactcttgggcaaaacctgaacataaaggcctcccatttcgtggtggttgagagccagcccctcttccccctctggctcttgtgacccccatcacagggtggggagacaccccccgcaaggcggggactgagagccagcccctcttcccccactggcttaggacgcccatcggggatcctaagatccttaggaaccacctggaggactgtgggtatgaggtgttcaagaagaaagctcaaatcttccgacggcaggtaccttgcgtgggatttacaataagacatgggtccgaacgcagctcgggaacagaaagaaagcaggttatttgcaatctaccggagcttaagggcagaaggcaggtgagagaattcttaggagctgtggggtttcgtagactgtggatcccaaacattgcagtattagccaagcctttgtatgaggtcacaaagggggcggggacccggaaactttgaaatggggatcccgacaacagcaagtctttcattagttaaaggaaaaacttctggcagccccagccctggggctacccgatctgacaaagccttttccattgtatgcgtcagagagagaaaagatggcagctggacttttaacccaaactgtggggccctggctgaggccggtagcctacgtctctaaacaactagacaggtttctaaaggatggcccccctattagagggccttggcagcaactgccctgctagtacaagaagcaaataagctgattcttgggtaaaacctgaatataaaggccccccattttgtgatggctgagatccatcccctcttcccccctggctcttgggactcccatcgcagtggggggaggcaccccccgcgaggcggggactcagagccaacccctcttccccgcctggctcttgggaccactatcgcagtgggggaggcaatccccgcgaggcggggactgcgaacctccccctttcctcccctggctctttgcaccctcatcgcaggggaggaggcacccctcacgacacggggactgagagcgagcccctcttcccccctttgctcttaggacccccatcgctgggggcggaggcaccccccgcgaggcagggactgagagccagtccctcttccccccctggctctggggacccccatcgcaggagggggaggcaccccccgcgagggtggggactgagagccagaccctcttcccccccggcttaggaccccccatcgttgatcctaagatccttaggacccacctggaggactgtgggtgttagttgtccaagtagaaagttcaaatcttccgacggcaggtaccttacgtgggattactgagagccagtccctcttccccccctggctctggggacccccatcgcaggagggggaggcaccccccacgagagtggggactgagagctatcccctcttccgcccctggctgtgagtacccccatcgcagggggggaggcacccccgcgaggcagggactgagagccagtccctcttcccccccgggttcttaggacccccatcgcaggagggggaggcaaccccacgagggtggggactgagagctatcccctcttccgcccctggctgttggtacccccatcgcaggaggggggaggcacccccccgaggcagagattgagagccagcccctggttcccccactggctcttaggacccccatcgcagaggtgggaggcaccccccgcgaggcggggactgagagccagaccctcttcccccaccggcttaggacccccgatcgttgatcctaagatccttaggacccacctggaggactgtgggtgttagtagtccaagtagaaagttcaaatcttccgacagcaggtaccttacgtgggattactgagagccagaccctcttccccgccccccggctctgaggaccccgatcgcaggagggggaggcacccaccacaagagtggggactgagagctatcccctcttccacccctggctgttagtacccccatcgcaggggggaggcaccccccgcgaggcagggactgagagccagcccctggttcccccactggctcttaggacccccatcgcagaggggggaggcaccccccgcgaggcggggactgagagccagaccctcttcccctcctggcttaggacccccccatcgttgctcctaagatccttaggacccacctggaggactgtgggtgttaggtgtccaagtagaaagttcaaatcttccgaccttacgtgggatttacgatccgacgggtccgaacgcagctcgggaacagaaagaaagcaggttatttgcaatctaccggagcttaagggcagaaggcaggtgagagaattcttaggagctgtggggttttgtaggctgtggatcccaaactgcagtattagccaagcctttgtatgaggtcacaaatggggcggggacccggaacttttgaaatggggatcccaacaacagcaagtttttcatgagttacaagaaaatcttctggcagcccacccgacctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgagggccttggcagcaactgccctgctagtacaagaagcaaataagctgattcttgggcaaaacctgaacataaaggccccccattttgtgatggctgagatccatcccctcttcccccctggctcttgggactcccatcacagggggggaggcaccccccgcgaggtggggactcagagccaacccctcttccccccatggctcttgggaccaccatagcagggggggaggcaattcccgcgaggcggggactgcgaacctccccctttcctcccctggctctttgcaccgccatcgcagggggggaggcacccctcgcgacgcggggactgagagcgagcccctcttcccccctttgctcttaggacccccatcgctgggggcggaggcaccctccgcgaggcagggactgagtgccagtccctcttcccccgctggctctggggacccccatcgcaggagggggaggcaccccccgcgagggtggggactgagagccagaccctcttcccccctggcttaggaccccccatcattgatcctaagatccttaggacccacctggaggactgtgggtgttagttgtccaagtagaaagttcaaatcttccgacggcaggtaccttacgtgggattactgagagccagtccctcttcccccccgggttcttaggacccccatcgcacgagggggaggcaccccccgcgaaggtggggactgagagctatcccctcttccacccccggctgttgctacccccatcgcaggggggggaggcaccccccgcgaggcagggattgagagccatcccctagttcctccactggctcttaggacccccatcgcagaggggggaggcaccccccgcgaggcggggactgagagccagaccctcttccccccccggcttaggaccccgcatcgttgatcctaagatccttaggacccacctggaggactgtgggtgttagttgtccaagtagaaagttcaaatcttccaacggcaggtaccttacgtgggattactgagagctatcccctcttccgcccctggctgttactacccccatcacagggggggaggcaccccccacgaggcagggactgagagccagtccctcttccccccctggctcttaggacccccatcgcacgagggggaggcaccccccgcgagggtggggactgagagctatcccctcttccgcccctggctgttggtacccccatcgcaggggggcggaggcaccccccgcgaggcagggactgagagccagcccctggttcccccactggctcttaggacccccatcgcagaggggggaggcactccccgcgaggcggggactgagagccagaccctcatccccccctggcttaggaccccccatcgttgctcctaagatccttaggacccacctggaggactgtgggtgttaggtgtccaattagaaagttcaaatcttccgacggcagataccttacatgggatttacgatccgacgggtccgaacgcagctccagctcgggaacagaaagaaagcaggttatttgcaatctaccggagcttaagggcagaaggcaggtgagagaattcttaggagctgtggggtttcgtagactgtggatcccaaacattgcagtattagccaagcctttgtatgaggtcacaaaggggtcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgagggccttggcagcaactgccctgctagtacaagaagcaaataagctgattcttgggcaaaacctgaacataaaggccccccattttgtgatggctgagatccatcccctcttcccccctggctcttgggactcccatcgcggggggggaggcaccccccacgaggcggggactcagagccaacccctcttccccccctggctctttgcacccccatcgcaggggggggagcacccctcgcgacgcggggactgagagcgagcccctcttcccacctttgctcttaggaccccatcgctgggggcggaggcaccccccgcgaggcagggactgagagccagtccctcttcccgccctggctctgaggacccccatcgcaggagggcgaggcaccccccgcgagggtggggactgagagctatcccctcttccgcccctggctgttggtacccccatcgcagggggggagaggcaacccccgcaaggcagggactgagagccagtccctggttcccccactggctcttaggaaccccatcgcagaggggggacgcaccccccgcgaggcggggactgagagccagaccatcttcaccccctggcttaggacccccatcgctgatcctaagatccttaggacccacctggaggactgcgagtgttagttgtccaagtagaaagttcaaatcttccgacggcaggtaccttacgtgggattactgagagccagtccctcttcccccccggctctgcggacccccatcgcaggagggggaggcaccccccacgagagtggggactgagagctatcccctcttccgcccctggctgttactacccccatcgcaacgggggaggcaccccccgcgagtcagggactgagagccagtccctcttccccccctggatcttaggacccccatcgcacgagggggaggcaccgcccgcgagggtggggactgagagctatcccctcttccgcccctggctgttggtacccccatcgcaaggggggggaggcactctccacgaggcagggactgagagccagcccctggttcccccactggctcttaggacccccatggcagaggtgggaggcaccccccgtgaggcggggactgagagccagaccctcttccccccctggcttaggacccccatcgttgatcctaagatccttaggacctacctggaggactgtgggttttaggtgtccaagtagaaagttcaaatcttccgacggcaggtaccttacgtgggattactgagagccagtccctcttccccccctggctctgaggacccccatcacaggagggggaggcaccccccacgagagtggggactgagagttatcccctcttccgcccctggctgttagtacccccatcgcagggtgggggaggcaccccccgcgaggtagggactgagagccagcccctgttcccccactggctcttaggacacccatcgcagaggggggaggcaccccccacgaggcggggactgagagccagaccctcttccccccctggcttagggcccccttcgttgatcctaggatccttaggacccacctggaggactgtgggtattaggtgtccaagtagaaagttcaaatcttccgacggcaggtaccttacgtgggatttacgatccgacgggtccgaaggcagctcgggaacagaaagaaagcaggttatttgcaatctaccggagcttaagggcagaaggcaggtgagagaattcttaggagctgtgggattttgtagactgtggatcccaaactgcagtattagccaagcctttgtatgaggtcacaaagggggcggggacatggaagttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactaggtttttagttgctaaaggatggcccccctatttgagggccttggcagcaactgccctgctagtaaaagaagcaaataagctgattcttgggcaaaacctgaacataaaggccccctattttgtgatggct

SEQ ID NO: 370 - DNA, 3446 bp, Homo sapiens
gtcaggcctctgagcccaagctaagccatcatatcccctgtgacctgcacgtacacatccagatggccggttcctgccttaactgatgacattccaccacaaaagaagtgaaaatggtctgttcctgccttaactgatgacattgtcttgtgaaattccttctcctggctcatcctggctcaaaagctcccccactgagtaccttgtgatccccactcctgcccaccagaaaacaaccccctttgagggtaattttcctttatctacccaaatcctataaaacggccccaccccatctccctttgctgactctcttttcggactcagcctgcctgcaccccggtgattaaaagctttattgcttacacaaagcctgtttggtggtctcttcacacagacatgcatgaaatttggtgccgtgactcagatcgtgacctcccttgggaggtcctcctgttctttgctccttgagaaagatccacctatggtcctcagaccgaccagcccaagaaacatctcaccaatttcaaatctggtaagcggcctcttcttactctcttctccaacctccctcactatccctcaacctctttctcctttcaatcttggtgccacacttcaatctctcccttcttttaatttcaattcccttcattttctggtagagacaaaggagacacgttttatccgtggacccaaaactccggcgccggtcacggactgggaaggcagccttcccttggtgtttaatcattgcagggacgcctctctgattattcacccaggttttagaggtgtcagaccacgcagggacgcctgccttagtccttcacccttagcggcaagtcctgcttttctaggggagaggcaagtaccccaaccccttctctctgtgtctctaccccttctccacctttctggggggcaagaaacccgtaaccccttcttcttcactcttagcagcaagtcccgcttttctagaggggcaagtaccccaacttcatatctctgcaccccaatcccttatttccatgccccaacctcttatctctgtgccccaatcccttatttccacgccccaacccctttcctgcttttctggaaggtaagaacccccgaaccccttccctctgtgtctctactctctcttttctctaggcttgcttccttcactatgggcaaccttccactctccattcctccttcttctcccttagcctgtgtcctcaaaaacttaaaacctcttcaactcacacctgacctaaaatctaagcatcttattttcttctgcaataccgcttgaccccaatacaaactcgacagtagttccaaacagccggaaaacggcactttcaatttttccatcctacaagatctaaataaatcttgttgtaaagtgggcaaatggtctgaggtgcctgacgtccaggcattcttttacacgtcggtccctctctagtctctgttcccaaagcaactgttcccaaatcttccttctttccctcccacctgtcccctcagtcccaaccccaagcgtcgctgagtctttctaatcttccttttctacagacccatctgacctctcccctcctccccaggctgctcctcgccaggccgagctaggtcccaattcttcctcagcctccgctcctccaccctataatccttttatcacctcccctcctcacacctggtccggcttacagtttctttctgtgactagccctcccccacctgcccatcggtggctggagctaaaggcatagtcaaggttaatgcttctttttctttatcccaaatcagatagcatttaggctctttttcatcaaatataaaaatccagcccagttcatggctcctttggcagcaaccctgagacactttacagccctagaccctaaaaggtcaaaaggccgtcttattctcaaaatacattttattacccaatctgctcccaacattaaataaaactccaaaaattaaattccggccctcaaaccccacaacagaatttaattaacctcaccttcaaggtgtacaataatagaaaaaagttgcaattccttgccttcactgtgagacaaacctcagccacgtctccagcacacaagaacttccaaacgcctgaacctcagcggccaggcattcctccagaacctcctcccccaggagcttgctacaagtgccagaaatctggccaccaggccaaggaatgcctgcagcccaggattcctcctaagccacgtcccatctgtgcgggaccccactggaaattggactgtccaactcacctggcagccactcccagagcccctggaactctggcccaaggctctctgactgcttcccagatcttcttggcttagtggctgaagactaacgctgcccgatcgcctcggaagccccctagaccatcacggacgctgagcttcgggtaactctcacagtggagggtaagtccgtccccttcttaatcaatactgaggctacccactccacattaccttcttttcaagggcctgtttcccttgcctccataactgttgtgggtattgacagccaggcttctaaacctcttaaaactccccaactctggtgccaacttagacaatactcttttaggcactccttttagttatccccacctgcccagttcccttattaggccgagacactttaactaaattatctgcttccctgactattcctggattacagctatatttcattgcctcccttcttcccaatccaaagcctcctttgcatcctcttgtattccccgaccttaacccacaagtataagatacatctactccctccttggcgaccgatcatgcaccccttaccatctcattaaaacctaatcacccttaccccactcaatgccaatatcccatcccgcagcatgctttgaaaggattaaagcctgttatcgctcgcctgctacagcatggccttttaaagcctgtaaactctccttacaattcccccattttacctgtccaaaaaccggacaagtcttacagattagttcaggatctgtgccttatcaactaaattgttttgcctatccatcctgtggtgcccaacccgtacactcttttgtcctcaataccttcctccacaactcactattccgttctccatcttaaagatgcttttttcactattcccctgcacccctcgtcccagcctctctttgctttcacttagactgacactgacacccatcaggttcagcaagtcacctgggctgtactgccgcaaggcttcacagacagcccccattacttcagtcaagcccaaatttcatcctcatctgttacctatctcggcataattctcataaaagcacacgtgctttcgctgctgatcgtgtccaattaatctcccaaacctcaatcccttacaaaacaacaactcctttccttcctaggcatagttag

SEQ ID NO: 371 - DNA, 5840 bp, Homo sapiens
gtcaggcctcagagcccaagctaagccatcgtatcccctgtgacttgcacgtatatgcccagatggcctgaagtaactgaagaatcacaaaagaagtgaatgtgccctgccccgccttaactgatgacattccaccacaaaagaagtgtaaatggctggtccctgacttaagtgatgacattaccttctggaagtccttttcctggctcatcctggcacaaaaagcacccccactgagcaccttgcgacccccactcctgcccgccagagaacaaaccccctttgactataatttccctttacctacccaaatcctataaaacggccccacccttatctcccttagctgactctcttttcagactcagcccgcctgcacccaggtgaaataaacagccatgttgctcacacaaagcctgtttggtggtctcttcacaaggacgcgcaggaaatttggtgccgtgactcggatcaggggacctcccttgggagatcaatcccatcctcctgttctttgctccataagaaagatccacctacgacctcaggtcctcagacccaccagcccaaggaacatctcaccaattttaaatcaggtaagcggcctcttcttactctcttctccaacctctctctgtccctcaaccactttcttctttccactcttcaatctctcccttctcttaatttcaattcctttcattttctgggagagacaaaggagacacgttttatctgtggacccaaaactctggcgccggtcacggactgggaaggcagccttcccttggtgttcaatcattgcagggatgcctctctgattattcacccacgtttcaaaggtgtcagaccacgcagggacgcctgccttggtccttcacccttagcggcaagtcccgcttttctggggaaggggcaagtaccccaaccccttctctccttgtctctaccccttctctgctttcctggggaagggtcaagtacccctcaaccccttctctttcacccttagcggcaagtcccacttttctggggcaggggcaagtacccctcaaccccttctctttcacccttagcggcaagtcccgcttttctagggggcaagaaccccaatcccttatttccacaccccaacctcgtatctctgtgccccaatcccttatttccatgccccgaccccttatttccatgccctgaccccttatttctgcaccccatcccttatttctgcaccccaacctcttatctctgtgccccaaccccttttcccacttttctggaaggtaagaacccctgaaccccttccctccgtttctctactctctcttttctctaggcttgcttcctttactataggcaaccttccaccctccattcctccttctactcccttggcctgtgttctcaaaaacttaaaacctcttcaagtcacacctgacctaaaacctaaatgccttattttcttctgcaatgccgcttgaccccaatacaaactcgacagtagttccaaatagccagaaagtggcactttgaatttttccatcctgcaagatctaaataattcttgtcataaaacaggcaaacggtctgaggtgcctgacgtccaggcattcttttacacatcagtcccttcctagtctctgtacccagtgcaactcatcccaaatcttcctactttccctcccacctgtcccctcagtcccaacgccaagtgtcactgagtctttgtaatcttccttttctacagacccatctgacctctcccctcctcgccaggccgagctaggtcccaattcttcctcagcctccgccctccaccctataatctttttatcacctcccctcctcatacctggtcgggcttacagttttgttctgtgactagccctcccccacctgcccagcaatttactcttaaaaaggtggctggagccaaaggcatagtcaaggttaatgttcctttttctttatcccaaatcagatggcgtttaggctctttttcatcaaatataaaaatccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattccggcgctcaaaccccacaaaaggatttaattaaccttgccttcaaggtgtacaataatataaaaaagttgcaattccttgcctccactgtgagacaaaccccagccacatctccagcacacaagaacttccaaaggcctgaaccgcagcggccaggcattcctccagaacctcctcccacaggagcttgctacacgtgccggaaatctggccactgggccaaggaatggccgcagcccaggattcctcctaagccatgtcccatctgtgtgggaccccactgaaaatcagattgttcaactcacctggcagccactcccagagaccctggaactctggcccaaggctctctgactgactccttcccagatcttctcggcttagcggctgaagactgacactgcccgatcgcctcagaagcccccagaccatcacaaacgctgagcttccggtaactctcacagtggaaggtaagcccatccccttcttaatcaatacggaggctacccactccacgttaccttcttttcaagggcctgtttcccttgcctccataactgttgtgggtattgacagccaggcttctaaacctcttaaaactccccaactctggtgccaacttagacaatactcttttaagcactcctttcagttatccccacctgcccagttcccttattaggctgagacactttaactaaattatctgcttccctgactattcctggactacagctacatctcattgccgcccttcttcccaatccaaagcctcctttgcgtcctcctcttgtatccctccaccttaacccacaagtataagatacctctactccctccttggcaaccgatcatgcaccccttaccatctcgttaaaacctaatcacccttaccccactcaatgccaatatcccatcccgcaacacgctttaaaaagattaaagcctgttatcactcgcctgctacagcatggccttttaaagcctataaactctccttacaattcccccattttacctgtcctaaaaccagacaagccttacaagttagttcaggatctgctccttatcaaccaaattgttttgcctatacaccccgtggtgccaaacccatatactctcctatcctcaatacctgcctctacaacccattattctgttctagatctcaaacatgctttctttactattcctttgcacccttagtcccagcctctcttcactttcacttggactgaccctgacacccatcaagctcagcaaattacctaggctgtactactgcaaagcttcacagacagcccccattacttcaatcaagcccaaatttcttcctcatctgttacctatctcggcataattctcataaaaacacacatgctctccctgccaatcgtgtccgactgatctctcaaaccccagcaccttctacaaaacaacaactcctttccttcctaggcatggttagcgtggtcagaattcttacacgagagccaggaccacaccctgtagcctttctgtccaaacaacttgatcttactgttttagcctagccctcatgtctgcgtgcagcggctgccactgccttaatacttttagaggccctcaaaatcacaaactatgctcaactcactctctacagttctcataacttccaaaatctattttcttcctcatacctgacgcatatactttctgcttcccggctccttcagctatactcactctttgttgagtctcccacaattaccgtttttcctggcccagacttcattccggcctcccacattgttcctgataccacacctgacccccatgattgtatctctctgatccacctgacattcaccccatttctccaaatttccttctttcctgttcctcaccctgatcacgcttgatttattgatggcggttccaccaggcctaattgccacccaccagcaaaggcaggttatgctatagtacaagccagtagcctgcctcttggaacctctcatttcctttccatcatggaaatctatcctcaaggaaataacttctcagtgttccatctgctattctactactcctcagggattattcaggccccctcccttccctacacatcaagctcgaggatttgccccacccaggactggcaaattagctttactcaacatgccctgagtcagataactaaaatacctcttagtctaggtagatactttcactggataattagaggcctttcctacagggtctgagaaggccaccgcagtcatttcttcccttctgtcagacataattcctcagtttagccttcccacctcaatacagtctgataacagacaagcctttattagtcaaatcagccaagcagtttttcaggctcttagtattcagtgaaacatttatatcccttacggtcctccatcttcaagaaaagtagaatggactaaaggtcttttaaaaacacacctcaccaagctcagccaccaacttaaaaaggactggacaatacttttaccactttcccttctcagaattcaggcttatcctcggaatgctacagggtacagcccatttgagctcctgtagagatgctcctttttattaggccctagtctcattccagacaccagaccaacttagactgtacccccaaaaaaacttgtcatccctactatcttccatctagtcatactcctatttaccgttctcaactactcatacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagtcatcccaattcttagaccttttatacctgtttttctccttctgttattccatttagtttctcaattcatccaaaaccgtatccaggccatcaccaatcattctatacgacaaatgtttcttctaacatccccacaatgtcaccccttaccacgagacctcccttcagcttaatgtctcccactctaggttcccacgccgcccctaatcccgcttaaagcagccctgagaaacatcgccattctctctccataccaccccccaaaaattttcgccgccccaacacttcaacaccattttgttttatttttcttattaatataagaaggcaggaatgtcaggcctctgagcccaagccaagccatcgcatcccctgtgacttgcacgtatatgcccagatggcctgaagtaactgaagaatcacaaaagaagtgaatgtgccctgccccgccttaactgatgacattccaccacaaaagaagtgtaaatggccggtccctgccttaagtgatgacattaccttgtgaaagtccttttcctggctcatcctggctcaaaaagctcccccactgagcaccttgcgacccccactcctgcccgccagagaacaaaccccctttgactgtaattttcctttacctacccaaatcctataaaacggccccacccttaactcccttagctgactctcttttcagactcagcccgcctgcacccaggtgaaataaacagccatgttgctcacacaaagcctgtttggtggtctcttcacagggacgcgcatgaaa

SEQ ID NO: 372 - DNA, 6308 bp, Homo sapiens
gtcaggcctctgagcccaagccaagccatcgcatcccctgtgacttgcacctatatgcccagatggcctgaagtaactgaagaatcacaaaagaagtgaaaatgccctgccccgccttaactgatgacattccacctcaaaagaaatgtaaatggctggtccttgccttaagtgatgacattaccttgtgaaagtctttttcctggctcatgatggctcaaaaacacccccactgagcaccttgcgacccccaaccctgcccaccagagaacaaatcccctttgactgtaatttttctttatctgcccaaatcttataaaacggccccacccctatctcccttcgatgactgtcttttcggactcagcctgcctgcccccctgtgaaataaacagccatgttgctcacacaaagcctgtttggtggtctcttcacacggatgcgagtgaaatttggtgctgtgactcagatcaggggacctcccttgggagatcaatcccctgtcctcctgttctttgctcggtaagaaagatccacttatgacctcaggtcctcagaccgaccagcccaagaaacatctcaccaatttcaaatccggtaagcggcctctttttactctcttctccaacctccttcactatccctcaacctctttctcctttcaatctcggcaccacacttcaatctctcccttcttttaatttcaattcctttcattttctggtagagacaaaggagacacattttatccgtagacccaaaactccggcgctggtgatagactgggaaggcagccttcccttggtgtttaatcattgcagggacacctctctgattattcacccacgtttcagaggtgtcagaccacgcagggacgcctgccttggtccttcacccttagcagcaagtcccacttttctgggggaggggcaagtaccccaaccccttctctctgtgtctctaccccttttccacctttctggggggcaagaaacccccaaccccttctccttcacccttagcggcaagtcctgcttttctaggggaggggcaagtaccctaaccccatatatctctgtgccccgatcccttatttctgtgccccaacctcttatatctctgtgccccaatcccttatttctatgccccgacctcgtatctctgtgccccgacccctttcccacttttctggagggtaagaacccccaaaccccttccctccatgtctctactctctcttttctctgggcttgcctccttcactatgggcaaccttccaccctccattcctccttctccctttgcctgtgttcttaagaacttaaaacctcttcaactctcaaatgacctaaaatctaagcatcttattttcttctgcaatgccacttgaccccaatacaaactcgacagtagttccaaatagccagaaaatggcactttcaatttttccatcctgcaagatctaaataattcttgtcataaaatgggcaaatggtctgaggtgcctgacgtccaggcattcttttacacattggtccctctctagtctctgttcccaatgcaacagatcccaaatcttccttctttccctcccacctgtcccctcagtcccaaccccaagcatcgctgagtctttctaatcttccttttctacagacccatctgacctctcccctcctccccaggctgctcctcgccaggccgagctaggtcccaattcttcctcagcctccgctcctccaccctataatccttttatcacctcccctcctcacacctggtccggcttacagtttcattccatgactagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatgactcctttggcagcaaccctgagacactttacagccctagaccctaaaaggtcaaaaggccgtcttattctcaaaatacattttattacccaatctgctcccgacattaaataaaactccaaaaattaaattctggccctcaaaccccacaacaagatttaattaacctcgccttcaaggtatacaataatagaaaaaagttgcaattccttgcctccactgtgagacaaaccccagccacatctccagcacacaagaacttccaaatgtctgaaccacagcggccaggcattcctccagaacctcctcccccaggagcttgcttcagaaatctggccacaaggccaaggaatgcctgcagcccaggattcctcctaagctgcgtcccatctttgtgggaccccactggaaattggactgtccaactcacctggcagccactcccagagtccctggaactctggcccaaggctctctgactgactccttcccagatcttctcggcttagcggctgaagactgacactgcctgatcgcctcggaagccccctagaccatcacggacgccgagcttcaggtaactctcacagtggaaggtaagcccgtccccttcttaatcaatacggaggctacccactccacattaccttcttttcaagggcctgtttcccttgcctccataactgttgtgggtattgacagccaggcttctaaacctcttaaaactccccaactctggtgccaacttagacaatactcttctaagcactccttttaattatccccacctgcccagttcccttattaggctgagacactttaactaaattatctgcttccctgactattcctggattacagctacatctcattgctgcccttcttcccaatccaaagcctcctttgcgtcctcctcttgtatccccccaccttaacccacaagtataagatacctctactccctctttggtgaccgatcacgcaccccttaccatctcattaaaacccaatcacccttaccctgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttcgtttaggatctatgccttatcaaccaaattgttttcctaaccaccccatggtgccaaacccatatactctcctatcctcaatacctccctccacaatccattattctgttctggatctcaaacatgctttctttactattcctttgcacccgtcatcccagcctctcttcgctttcatttggactgaccctgacacccatcaggctcagcaaattacctgggctgtactgccgcaaagcttcacagacagcccccattacttcagtcaagcccaaatttcttcctcatctgttacctatctcatcataactctcataaaaacacacgtgctctccctgccaatcgtgtccgactgatctctcaaaccctagcaccttctacaaaacaacatctcctttccttcctaggcatggttatcgtggtcagaattcttacacacaagagccagtaccacaccctgtagcctttctgtccaaacaacttgaccttactgttttagcctagccctcatgtctgcgtgcagtggctgccgctactttaatacttttagaggccctcaaaatcacaaactatgctcaactcactctttacagttctcataacttccaaaatctattttcttcctcatacctgacgcatatactttctgcttcccggctccttcagctatactcactgtttgttgagtctcccacaattaccgttgttcctggcccgaacttcaatccagcctcccacattattctggataccacacctgaccctcatgattgcatctctctgatccacctgacgttcaccccatttccccacatttccttcttccctgtttctcaccctgatcacacttggtttattgatggcagttccaccaggcctaattgccactcaccagcaaaggcaggctatgctatagtatcttccacatctatcattgaggctaccactctgcccccctccactacctctcagcaagccaaactagttgccttaactcaagccctcactcttgcaaaaggactacgcgtcaatatctatactgattctaaatatgcctttcatattctgcaccaccatgcggtcatatgggctgaaagaggttttctcactacacaagggtcctccatcatgaatgcctctttaataataactctactcaaggccgctttacttccaaaggaagctggggtcattcactgtaaggggcatcaaaaggcatcagatcccattgctctaggcaacgcttgtgctgataaggtggctagacaagcagctagctctccaacttctgtccctcacggccagtttttctccttcacatcggtcactcccacctactcccctgctgaaacttccacctatcagtctcttctcacacaaggcaaatggttcttagaccaaggaaaacatatccttccagcctcacaggcccattctattctgtcgtcatttcataacctcttccatgtaggttacaagccgctagcccgtctcttagaacctctcatttcctttccatcatagaaatctatcctcaaggagatcactgctcagtgttccatctgctattctactacccctcatggattgttcaggcctcctcccttccctacacatcaagctcgaggatttgcccccacccaggactggcaaattgactttactcacatgcctcgagtcagaaaactaaaatatctcttagtctgggtagacactttgactggataagtagaagcctttcctacagggtctgagaaggccaccgcagtcatttcttcccttctgtcagacataattcctcagtttagccttcccacctctgtacagtctgataacagaccagcctttattagtcaaatcagccaagcagtttttcaggctgttagtattcagtgaaacctttatatcccttacagtcctcagtcttcaggaaaagtagaacagactaatggtcttttaaaaacacacctcaccaagcttagccaccaacttaaaaaggactggacaatacttttaccactttcgcttctcagaattcaggcctgtcctcggaatgctacaaggtacagcccatttaagctcctgaataagacactcctttttattaggcctcagtctcattccagacaccagagcaacttagactgtgccccaaaaaacttatcatccttactatcttctgtctagtcatactcctattcactgttctcagctactcatacatgccctgctcttgtttacactgccagtttacactgtttctccaagtcatcacagctgatatctcctggtgctatccccaaactgccactctaaactcttgaagtaaataaataatctttgctggcaggactatgctgaatctccttaggcactctctaatcagatgtcctgggtgctcccaagtcttagaccttttatacctgtttttctccttctcttattccatttagtttttcaattcatacaaaaccatatccaggccatcaccaataattctacatgacaaatgtttcttctaacaaccccacaacatcaccccttaccacaaaatcttccttcagtttaatctctcccactctaggttcccacgctgccccaatcccgctcgaagcagccctgagaaatgttgcccattctctctctccatactaccccccaaaaatttttgctgcccccacacttcaacactattttgttttatttttcttattaatataagaaggcaggaatgtcaggcctctgagcccaagccaagccatcgtatcccctgtgacttgcatgtatatgccgagatggcctgaagtaacagaagaatcacaaaagaaatgaaaatgccctgccctgccttaactggtgatattccaccacaaaagaagtgtaaatggccggtccttgccttatatgatgacattaccttgtgaaagtctttttcctggctcatcaagctcccccactgagcaccttgcgacccccactcctgcccaccagagaacaaaccccctttgactgtaattttcctttacctgcccaaatcttacaaaatggccccacccctatctcccttcgctgactctcttttcggactcagcccacctgcacccaggtgaaataaacagccatgttgctcacacaaagcctgtttggtggtctcttcacacggacgcgcatgaaa

SEQ ID NO: 373 - DNA, 5913 bp, Homo sapiens
gtcaggcctctgagcccaagctaagccatcatattccctgtgacctgcacatacacatccagatggccggtttctgccttaactgatgacattccaccacaaaagaagtgaaaatgtcctgttcctgctttaactgatgacattgtcttgtgaaattccttctcctggctcatcctggctcaaaagctcccccactgagtaccttgtgacccccactcctgcccaccagagaacaacccccctttttcctttaccttcccaaatcctataaaatggccccaccccatctcccttcgctgactctctttttggactcagccaccagcacccaggtaaaataaacagccatgttgctcacacaaagcctgtttggtggtctcttcacacggtcgcgcatgaaatttggtgccgtgactcggatcggggaacctcccttgggagatcaatcccctgtcctcctgctctttgctccgtgagaaagatccacctacgacctcaggtcttcagaccaaccagcccaagaaacatctcaccaatttcaaatccagtaagtggcctctttttacttacttctccaacctccctcactatccctcaacctctttctcctttcaatcttggcgccacacttcaatctctcccttcttttaatttcaattcctttcattttctggtagagacaaaggagacacgtttcatccgtggacccaaaactccggtgccagtcacagactgggaaggcagccttcccttggtgtttaatcattgcagggacgcctctctgattattcacccacatttcagaggtgtcacactacacagggacacctgccttggtccttcacctttagcaggaagtcccacttttctgggggaggggcaagtaccccaaccccttctctccatgtctctaccccttctccgcctttctggggggcaagaaacccccaaccccttctccttcacacttagcagcaagtcccacttttctgggggaggggcaagtaccccaacctcatatctctgctccccgatcccttatttctgtgccctgacctcttacatctctgcaccccaatcccttatttccgtgccctgacctcttatctctgcgccctgatcccttatttccacgccccgacctcttatctctgtgccccaaccccttatttctgtgccctgacccctttcccgcttttctggagggtaagaacccctgaaccccttccctctgtgtctctactctcccttttctctgggcttgcctccttcactatgggcaactttccaccctccattcctccaactcccttagcctgtgctctcaagaacttaaaacctcttcaactcacacctgacctaaaacctaaatgccttattttcttctgcaatgccgcttgaccccaatacaaactcgacagtagttccaaatagccagaaaatggcactttcaagttttccatcctgcaagatctaaataattcttgttgtaaaataggcaaacggtctgaggtgcctgatgtccaggcattcttttacacatcagtcccttcctagtctctgtgcccaatgcaacttgtcccaaatcttccttctttccctccctcctgtcccctcagtcccaaccccaagcgtcactgggtctttctaatcttccttttctccagacccatctgacctctcccctcctccccaggctgcttctcgccaggtcgagctaggtcccaattcttcctcagcctccgctcctccactctataatctttttatcaccacccctcctcacacccagtctggcttacagtttcattctgcgactagccctcccccacctgcccagcaatttcctcttaaaaaggtggctggagctaaaggtatagtcaaggttaatgctcctttttctttatccgacctctcccaaatcagttagcatttagactctttttcgtcaaatataaaaatcccagcccagttcatggcttgttcggtagcaaccctgagacactttacagccctagaccctaaaaggtcaaaaggctgtcttattctcaatatacattttattacccaatctgctcctgacattaaataaaactccaaaaattaaattctggccctcaaaccctacaacaggatttaattaacctcaccttcaaggtgtacaataatagaaaaaagttgcaattccttgcctccactgtgagacaaaccccagccacatctccagcacacaagaacttccaaatgcctgaaccacagcggccaggcatttctccagaacctcctctcccaggagcttgctacaagtgccagaaatctggccactgggccaaggaatgctcacagcccagaattcctcctaagccgcgtcccatctgtgcaggaccccactggaaattggactgttcaactcacttggcaaccactcccagagcccatggaactctggcccaaggctctctgactgagtccttcccagatcttctcggcttagcagctgaagactgacactgcctgatcaccttggaagcctacaggaccatcacagatgctctaggtaactctcacagtggagggtaagtctgtccccttcttaatcaatatggaggctacccactgcacattaccttcttttcaagggcctgtttcccttgcctccataactgttgtgggtattggcggccaggcttctaaacctcttaaaaccccccaactctggtgccaacttagacaatactcttttaagcacccctttttaattatccccacctgcccagttcccttattaggctgaggcactttaactaaattatctgcttccctgactattcctggactacagccgcatctcattgctgcccttctccccaacccaaagcctccttcatgtcctcctcttgtatccccctaccttaacccacaagtataagatacctctaatccctccttggtgaccgattatgcaccccttaccatctcattaaaacctaatcacctttgccctgctcaatgccaagatcccatcccacagcacgctttgggcattaaagcctgttatcactcgcctgctacagcatggtgttttaaagcctataaactctccttacaattcccccattttacctatcctagaacaagacaagccttacaagttagttcaggatctgcgccttatcaaccaaattgttttgcctatccaccccatggtgccgaacccatatactctcctatcctcaatacctccctctacaacccattattctgttctagatctcaaacatgctttctttactattcctttgcacccttcatcccagcctctcttcgctttcacttggactgaccctgacacccatcaggctcagcaaattacctgggctgtactgctgcaaggcttcacagacatccctcattacttcagtcaagctcaaatttcttcctcatctgttacctgtctcagcgtaattcttataaaaacacacgtgctctccctgccgatcatgtctgactgatctctcaaaccccaacaccttctacatcctaggcatggttagatactttcgactttagatacctggttttgccatcctaacaaaaccattatataaactcacaaaaagaaacctagctgaccccatagatcctaaatcctttccccactcgtttttctgttccttgaagacagctttagagactgcccacaaccgagctctccctgactcatcccaacccttttcattacacacagctgaagtgcagggctgtgcagtcagaatttttacaggactgggatcgcgtcctgtagcctttttgtccaaacaacttgaccttactgttttaggctgaccatcatgtctccgtgcagtggctcctgcccccctaatactttcagaggcctttaaaataacaaactatgctcaactcactctctacagttctcataacttccaaaatctatcttcttcctcatacctgattcatatactttctgctccccagctccttcagctgtactcactctttgttaagtcccacaattatcattgttcctggcccagacttcaatctggcctcccacattattcctgataccacacctgaccctcatgactgtatctctctgatccacctgacgttcaccccatttccccacatttccttcttccctgtttctcaccctgatcacacttagtttattgatggcagctccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagcttgaggatttgcccccacccaggactggcaaattagctttactcaacatgccccgagtcagataactaaaatacctcttagtctaggtagacactttcactggataggtagaggcctttcctacagggtctgagaaggccaccgcagtcatttcttcccttctgtcagacataattcctcagtttagccttcccacctctctacagtctgataacagaccagcctttattagtcaaatcagccaagcagtttttcaggctcttagtattcagtgaaacctttatatcccttacggtcctccatcttcaggaaaagtagaacggagtaaaggtcttttaaaaacacacctcaccaagctcagccaccaacttaaaaaggactggacaatacttttactactttcccttctcagaagtcagacctgtcctcagaatgctacaaggtacagcccatttgagctcctgtatagacgctccgttttattaggcccagtctcattccagacaccagaccaacttagactgtgccccaaaaaacttgtcatccctactatcttctgtctagtcatactcttattcaccgttctcaactactcatacatgccctgctcttgtttacactgccggtttacaccgtttctccaagccatcacagctgatatttcctggtgctatccccaaactgccactcttaactcttgaagtaaataatctttgctggtaggactatgctgaatctccttaggcactctctaatcagatgtcctgagtcgtcccaattcttagaccttttatacctatttttctccttctctcattccatttagtttttcaattcatacaaaactgtatccaggccatcaccaataattctaaatgacaaatattccttctaacaaccccacaatatcaccccttaccacaaaatctcccttcagattaatctctcccactctaggttcccatgccacccctaatcccgctcgaagcagccctgagaaacatcgcccattatctctccataccatcccccaaaattttcgctgtccgaacactttaccactatttcattttatttttcttattaatataagaagataggaatatcaggcctctgagcccaagctaagccatcatattccctgtggcctgcacgtacacatccagatggccggttcctgccttaactgatgacattccaccacaaaagaagtgaaaatggcctgttcctgctttaactgatgacattgtcttgcgaaattcctcctcctggctcatcctggctcaaaagctcccccactgagtaccttgtgaccccctcagtcctgcctgccagagaacaacacccctttttcctttacctacccaaatcctataaaacggccccaccccatctctcttcgctgactctctttttggactcagcccgcctgcacccaggtgaaataaacagccatgttgctcacacaaagcctgtttggtggtctcttcacacggacgcgcatgaaa

SEQ ID NO: 374 - DNA, 3684 bp, Homo sapiens
gtcaggcgtctcagcccaagccaagccatcgcatcccctgtgacttgcatgtatacgcccagatggcctgaagtaactgaagaatcacaaaagaagtgaatatgccctgccccaccttaacagatgacattccaccacaaaagaagtgtaaatggccggtccttgccttaagtgacgacattaccttgtgaaagtccttttcctggctcatcctgtctcaaaaagcacccccactgagcaccttgcaacccctactcctgcccgccagagaacaaaccccttttgactgtatttttcctttacctacccaaatcctataaaacagccccacacttttctcccttcactgactccctttttggattcagcccacctgcactcaggtgaaataaacagccatgttgctcacacaaagcctgtttggtggtctcttcacacggacgcacatgaaatttggtgccgtgacttggatcgggggacctcccttgggagatcaatcccctgtactcctgttttttgctccgtgagaagatccacctatgacctcaggtcatcagaccgaccagcccaaggaacatctcaccaattttaaatcaggtaagcggcctcttcttactctcttctgcaacctctctcactgtccctcaaccactttctcctttccactcttcaatctctcccttctcttaatttcaattcctttcattttctggaagagacaaaggagacacgttttttccatggacccaaaactccggcactggtcacggactgggaaggcagccttcccttggtgtttaatcattgcagggatgcctctctgattatacacccacgtttcaagggtgtctgaccatgcaggaacacctgccttggtcattcacccttagcggcaattcccgcttttctggggaaggggcaagtacctcaactccttctcgccttgtctctaccccttctctgcttttctgggagaggggcaagtacccttcaaccccttctccttcacccttagcggcaagtcccgcttttctatggggcaagaacacccaatcccttatttccacgccccagcctcttatctctgcaccccaatcccttatttccatgccccaacctcttatctctacaccccaatcccttatttccatgccccaacctcttatctctacaccccaatcccttatttctgcactccgacctcttatctctgtgccccaatcccttatttcagtgcctcaacctcatatctctgcaccccaatcccttatttccatgccctgacctcttatctctgtgccccaaccccttttcccacttttctggaaggtaagaacccccaaaccccttccttccatttctctactctctcttttctctaggcttgcttccttcactatgggcaaccttccatgctccattcttccttctactcccttggcctgtgttctcaaaaacttaaaacctcttcaagtcacacctgacctaaaacctaaatgccttatgttcttctgcaatgccacttgaccccaatacaaactcgacagtagttccaaatagccagaaaatggcactttgaatttttccatcctacaagatctaaataattcttgttgtaaaacaggcaaatggtctcaggtgcctgacgtccaggcattcttttacacatcagtcccttcctagtctctgtgcccagtgcaactcatcccaaatcttccttctttccctcccgcctgtcccctcagtaccaaccccaagtgtcgctgagtctttctaatcttccttttctacagaccaatctgacatctcccttcctccccaggctgctcctcaccaggccaagctacgtcccaattcttcctcagcctctgctcctctaccctataatctttttatcacctcccctcctcacacctggtccggcttacagtttccttccgtgactagccctcctccacctgcccagcaatttactcttaaaaaggtggccggagccaaagatatagtcaaggttaatgctcctttttctttatcccaaatcagaagtgtttaggctccttttcatcaaatataaaaacccagcccagttcatggctcatttggcagcaaccctgagacactttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggcgtacaataacagaaaaaagttgcaattctttgcctccactgtgagacaaaccccagccacatctccagcacacaagaacttccaaatgcctgaaccacagcagccaggcagtcctccagaacctcctcccccaggagcttgctacatatgcaaaatctggccactgggccaaggaatgcccacagcctgggattcctcctaagccgcgtcccatctgtgtgggaccccactgaaaaccggactgttcaactcacctggcagccattcccacagcccctggaactctggcccaaggctctctgactgactccttcagagatcttctccgcttagtggctgaagactgacactgcccgatcgcctcagaagccccctagaccatcacggacgctgaacttcgagtaactctcacagtggcgggtaattccgtccccttcttaatcattacggtggctacccactccacattaccttcttttcaagggcctgtttcccttgattccataactgttgtgggtattgatggccaggcttctaaacctcttaaaactccccaactctggtgccaacttagacaatactcttttaagcactcctttttagttgtccccacctgcccagttcccttattaggccgagacaatttaactaaattatctgcttccctgactattcctggactacagctatatctcattgccacccttcttcccaatccaaagtctcctttgcgtcctcttgtatcccccgaccttaacccacaagtataagatacctctactccctccttggtgaccgatcatgcaccccttaccatctcattaaaacctaatcacccttaccccactcaacaccaatatcccatcccgcagcatgctttaaaaagattaaagcctgttatcactcgtctgctacagcatggccttttaaatcctataaactctccttacaattcccccattttacctgtcctaaaaccagacaagccttacaagttagttcatgatctgcaccttatcaaccaaattgttttgcctatcccccctgtggtgtccaacccgtacactcttttgtcctcaataccttcctccacaactcactattctgtgcttgatcttaaagatgctttttcactattcccctgcaccccttgtcccagcctctcttcgcttccacttagactgaccctgacacccatcaggctcagcaaattacctaggctgtactgccgcaaggcttcatagacagcccctattacttcagtcaagcccaaatgtcatcctcatctgttacctatctcagcatagttctcatgaaaacatatgtgctttccctgctgatcatgtccgattaatctcccaaaccacaatcccttacaaaacaactcctttccttcctaggcatagttag

SEQ ID NO: 375 - DNA, 5698 bp, Homo sapiens
gttaggcctctgagcccaagccaagccatcgcatcccctgtgacttgcacatatatgcccagatggcctgaagtaactgaagaatcacaaaagaagtgaaaaggccctgccccgccttaactgatgacattccaccactgtgatttgttcctgccccaccttaactgagtgattaaccctgtgaatttccttctcctggctcagaagctaccccactgagcaccttgtgacccccgcccctgcccaccagagaacaacctcctttgactgtaattttccattaccttcccaaatcctataaaacggccccacccctatctcccttcgctgactctcttttcggactcaaccgcctgcacccaggtgaaataaacagccatgctgctcacacaaagcctgtttggtagtctcttcacacggacacacatgaaatttggtgccatgactcggatcgggggacctcccttgggagatcaatcccctgtcctcctgctctttgctccatgagaaagatccacctacgacctcaggtcctcagactgaccagcccaagaaacatctcaccaatttcaaatccggtaagcggcctctttttactatcttctccagcttccctcactatccctcaacctctttctcctttcaatcttggcaccacacttcaatctctcccttctcttaatttcaattcctttcattttctggtagagacaaaggagacacgttttatccatggacccaaaactccggtgccggtcacggactgggacggcagccttcccttgatgtttaatcattgcagggacacctctctgattattcacccacgtttcaaaggtgtcagaccacgcagggacacctgccttggtccttcacccttagcggcaagtcccgcttttctggggaaggggcaagtaccccaaccccttctctccttgtctctaccccttctctgcttttctgggggaggggcaagaacccctcaaccccttctccttcacccttagtggcaagtcccacttttctgggggaggggcaagtacccctcaaccccttctccttcacccttagcagcaagtcccacttttctagggggcaagaacccccaatcccttatttccgctccccaacctcttatctctgtgccccaattccttatttccatgccccaaccctttctctgcttttctggagggcaaggaacccctaccccttctctgtgtctctactcttttctctgggcttgcctccttcactatgggcaagattccaccttacattcctcctccttctcccttagcctatattcttaagaacttaaaacctctccaactttcactgacctaaaatctaagcgtcttattttcttctgcaatgccgcttgaccccaatacaaacttgacagtagttccaaacaccggaaaatggcactttcaatttttccatcctacaagatctaaataattcttgtcgtaaaaggggcaaatggtctgaggtgcctgacgtccaggcattcttttacacatcagtcccttcctagtctctgtgcccagtgcaactcatcccaaatcttccttctttccctcccgcctgtcccctcagtcccaaccccaagcgtcgctgagtctttctaatcttccttttctatagacccatgtgacctctcccctcctcaccaggccaagctaggtcccaattcttcctcagcctctgctcctccaccctgtaatctttttatcgcctcccctcctcacacctggtccggcttacagtttccttctgtgactagccctccccaacctgcccagcaatttactcttaaaaaggtgactggagccaaaggcatagtcaaggttaatgctcatttttctttatcccaaatcagaagcgtttaggctctttttcatcaaatataaaaacccagcccagttcatggcttgtgtggcagcaaccctgagatgctttacagccctagaccctaaaaggtcaaaaggccatcttattctcaatatacattttattacccaatctgctcccgacattaaataaaactccaaaaattagaatctggccctcaaaccccacaacaggacttaaccttaccttcaaggtgtacaataataaaaaaaaagttgcaactccttgcctccactgtgagacaaaccccagccacatctccagcacacaagaacttccaaacgcctgaaccgcagcagccaggcgttcctccagaacctcctcccccaggagcttgctacaagtgccagaaatctggccaccaggccaaggaatgcctgcagcccaggattcctcctaagccgtgtcccatctgtgcgggaccccatgggaaatcggactgttcaactcacctggcagccactcccagagcccctggaactctggcccaaggctctctgactgactccttcttggcttagcggctgaagactgatgctgtctgattgcctcggaagccccatagaccatcacggatgctgagctttaggtaactctcagagtggagggtaagtccgtccccttcttaatcaatacgaaggctacccactccacattaccttcttttcaagggcctgtttcccttgcctccataactgttgtgggtattgacagccaggcttctaaacctcttaaaactccccaactctggtgccaacttagacaatactcttttaagcactcttttttagttatccccacctgcccagttcccttattaggccgagatattttaaccaaattatctgcttccctgactattcccggactatagccgcatctcattgctgccgttcttcccaatccaaagcctcctttgcgtcctccttttgtattcccccaccttaacccacaagtataagatacctctactccctccttggcgaccgatcacgcaccccttaccatctcattaaaacctaatcaccctcaccccactcaatgccaatatcccatcccacagcatgctttaaaaggattaaagcctgttatcactcgcctgctacagcatgggcttctaaaacctataaactctccttaccattcccccattttacctgtcctaaaaccagacaaggcttaaaagttagttcagaatctgcgccttatcaaccaaattgttttgcctatccaccccgtggtgccaaacccatatactctcctatcctcaaaacctccgtctacaatccattattctgttctggatctcaaacatgctttctttactattcctttgcacccttcatcccagcctctctttgccttcacttagactgaccctgacacacattaggctcagcaaattacctgggctgtactgccgcaaggcttcacagacagcccccgttacttcagtcaagcccaaatttcatcctcatctgttacctatcttggcataattctcataaaaacacaggtgctctccctgctgatcatgtccaattaatctccaaaacctcaatcccttacaaaacaacaactcctttccttcctaggcatggttagtgtggtcagaattcttacacaagagccaggaccacaccgtgtagcctttctgtccaaacaaattgaccttactgtcttagcctagccctcatgtctgcatgcagcggctgccgctgctttaatactgttagaggccctaaaaaatcacaaactatgctcaactcactctctacatttctcgtaacttccaaaatctattttcttcctcatacctgacgcatatactttctgctccccagctccttcagctgaactcactctttaagtcccacaactaccattgtttctggcccggacttcaatctggcctcccacattattcctgataccacacctgacccccatgactgtatctctctgatccacctgatattcaccccatttccccatatttccttctttcctgtccctcaccctgaacacacttggtttattgatggcagttccaccaggcctaatcgccacacaccagcaaaggcaggctatgctatagtacgagccactagcccgcctctcagaacctctcatttcctttccatcgtggaaatctatcctcaaggaaataacttctcagtgttccatctgctattctactactcctcagggattattcaggccccctcccttccctacacatcaagctccaggatttgcccccacccaggacgggcaaattagctttactcaacatgtcccgagtcaggaaactaaaatagctcttagtctaaatagacgctttcactgaataagtaatggcctttcctacagggtctgagaaggccaccacagtcatttcttcccttctgtcagacataattcctcagtttagccttcccacctctatacagtctgataacagaccagcctttattagtcaaatcagccaagcagtttttcaggctctcagtattcagtgaaacctttatatcccttatggtcctccgtcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagacgctcctttttattaggccccagtctcattggacaccagaccaacttagactgtgccccaaaaaaacttgtcatccctactatcttttgtctagtcatactcctattcaccattctcaactactcatacatgccctgctcttgtttacactgctggtttacactgtttctccaagccatcacagctggtatctcctggtgctatccccaaactgccactctaaactcttgaagtaaataaataatctttgctggcaggactatggtgaatctccttaggcactctctaatcagatgtcctagctctcccaattcttagactttttatacctgtttttctccttctcttattccatttagtttttcaattcatacaaaaccgtatccaggccatcaccaatcattctatatgacaaatgtttcttctaacaaccccacaatatcaccccttaccacaagacctcccttcagcttaatctctcccactctaggttcccacactgcccctaatcctgttgaagcagccctgagaaacatcgcccattctctctccataccacccccaaaaattttcgccgccccaacacttcaacactattttgttttatttttcttattaatataaggaagcaggaatgtcaggcctctgagcccaagccaagccgtcgcatcccctgtgagttgcaggtatacgcccagatggcctaagtaactgaagaatcacaaaagtgaaaaggccctgccccgccttaactgatgacattccaccattgtgatttgttcctgccccaccttaactaagtgattaaccgtgtgaatttccttctcctggctcagaagctcccccactgagcaccttgtgaccccgcccctgcccaccagagaacaaccccctttgactgtaattttccattaccttcccaaatcctataaaacggtcccacccctatctcccttcgctgactctctttttggactcagcccacctgcacccaggtgaaataaacagccatattgctcacacaaagcctgtttggtggtctcttcacacggacccgcatgaaa

SEQ ID NO: 376 - DNA, 401 bp, Homo sapiens
gtcaggcctctgagcccaagctaagtcatcatatcccctgtgacctgcacgtatacatccagatggcctgaagtaactgaagaatctcaaaagaagtgaaaatggcctgttcctgccttaactgatgacattaccttgtgaaattccttctcctggctcatcctggctcaaaagctcccccactgagcacctggtgacccccacccctgcctgccagagaacaaccccctttgactgtaattttcctttacctacccaaatcttataaaacgaccccacccctatctcccttagctgactgtcttttcggactcagcccgcctgcactcaggtgaaataaacagccttgttgctcacacaaaggccagtttggtggtctcttcatacggacatgagtgaaa

SEQ ID NO: 377 - DNA, 2611 bp, Homo sapiens
tctgggaggtgtacccaagagctcattgagaacgggccatgataacgatggcggttttgtggaatagaaaagggggaaatgtggggaaaagaaagagagatcacccctccccctccccctccctctctccatggtctccctctccctctctttccacggtctccctctgatgccgagccgaagctggactgtactgctgccatctcggctcactgcaacctccctgcctgattctcctgcctcagcctgcggagtgcctgcgattgcaggcgcgcgccgccacgcctgactggttttcgtatttttttggtggagacggggtttcgctgtgttggccgggctggtctccagctcctaaccgccagtgatccgccagcctcggcctcccgcggtgccgggattgcagacggagtctggttcactcagtgctcaatggtgcccaggctggagtgcagtggcgtgatctcggctcgctacaacctccacctcccagccgcctgccttggcctcccaaagtgctgagagtgcagcctctgccaggccgacaccccgtctgggaattgaggagcgtctctgcctggccgcccatcgtctgggacgtgaggagcccctctgcctggctgcccagtctggaaagtgaggagtgtctctgcccggccgccatcccatctaggaagtgaggagcgcctcttcccggccgccatcccatctaggaagtgaggagcgtctctgcccggccacccatcgtctgagatgtggggagcgcctctgccccgccacctcatctgggatgtgaggagcacctctgcccggccgcgaccccgtctgggaggtgaggagcgtcactgcctagccgccccgtctgagaagtgaggagaccccccgcctggcaaccgccccgtctgagaagtgaggagcccctccgcccggcagccaccccgtctgggaagtgaggagcgtctccgcccggcagccaccccgtccgggagggaggtgggggggtcagcgccccgcccggccagccgccccgtccgagagggaggtggggagggtcagccccccgcccggccagccgccccgtctgggaggtgaggggcgcctctgcccagccgcccctactgggaagtgaggagcccctctgcccggccaccaccccgtctgggatgtgtacccaacagctcattgagaacgggccatgatgacagtggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccacagacctttgttcacttgtttatctgctgaccttccctccactattgtcctatgaccctgccaaatcctcctctgcgagaaacacccaagaatgatcaattaaaaaaaaaaaataaagctgtttaaacacaaaaaaaaaaaaaaaaaaagaaagagatcagattgttactgtgtctgtgtagaaagaactagacataggagactccattgtgttctgtactaagaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccacagacctttgttcacttgtttatctgctgaccttccctccactattgtcctatgaccctgccaaatcctcctctgcgagaaacacccaagaatgatcaattaaaaaaaaaaaataaagctgtttaaacacaaaaaaaaaaaaaaaaaaagaaagagatcagattgttactgtgtctgtgtagaaagaactagacataggagactccattgtgttctgtactaagaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatgctcgttaagagtcatcaccactccctaatctcaagtacccagggacacaaacactgcggaaggcggcggcggggcgctctgcctaggaaaaccagagagctttgttcacatgtttatctgctgaccttccctccactattgtcctatgaccctgccaaatccccctctctgagaaacagccaagaatgatcaataaatactaagaaaa

SEQ ID NO: 378 - DNA, 906 bp, Homo sapiens
aggaatgtcaggcaaccatcaggtgatgggcaggaaattattaaccatctctctaaaataataactggtcacagccagcaccagggaaaggtagtctcccaataaacaggaatacctgaagcaggtgatcagcagcttccagtaagatctcaggagctgggtgagtgggctcacacatgtgcatgaagaggcaaaatggcggcatttaactggtatatgacctgctagggacgttcggctggtaagggaagaacgcctcaagggagcatgcgtacaactacagtcaacacactgtgcatgctccctcccaagtgctggcaggtcactgagcgtgcggacagcccaccccaccaacccaagggaggaatcaggggataaggaaaacaagacccctgaagtatgccatgtataaaaccccaagtcaaaggtcaaacagaacccctgaatctctcaagtcgcctggttggcccctcttccaagtgtactttacttcttttcatccctgctctaaagctttttaataagctttcacttctgctgtgaaacttgcctcagtctctccttctgccttatgtccctcagtcgaattcttttttttgtctcactctgtcaccaggctggagtgcagtggcaccatctcggctcactgcaacctccacctcccaggttcaagtgattctcctgcctcagcctcccaagtagctgagattacaggtgcctgccaccacgcctggctaattttttgtattttcagtagagatgggtttcaccatgttagccaggatggtctcaatctcctgacctcaggatccgcccacctcggcctcctaaagtgctgggattacagccatgagaattctttcttctgaggaggcaagacctgaggatgctgaggcctgtatggat

SEQ ID NO: 379 - DNA, 146 bp, Homo sapiens
tccccaccaagcaccttgtgaccccgtcctgcccgccagagaacaaccccttgactataattttccactacctacacaaatcctataaaactgccccacccctatctccctttgctgactctcttttcagactcagccagtcagca

SEQ ID NO: 380 - DNA, 4529 bp, Homo sapiens
gtcaggcctctgagcccaagctaagccatcatatcccctgtgacctgcatgtacacatccagatggccggttcctgccttaactgatgacattgtcttgtgaaattccttctcctggctcatcctggctcaaaagctcccctactgagcaccttgtgacccccactctgcccgccagagaacaacccccctttgactgtaattttcctttatctacccaaatcctataaaatggccccacccttatctcccttcaaggactctcttttcagactcagcccacctgcacccaggtgattaaaagctttattgctcacacaaagcctgtttggtggtctcttcacacagacacgcatgaaatttggtgccgtgactcagatcgggggaccttccttgggagatcaatcccctgtcctcctgttctttgttccataagaaagatccacctacgacctcgggtcctcagaccgaccagcccaagaaacatctcaccaatttcaaatccagtaagcggcctattttcactctcttctccaacctccctcactatccctcaacctctttctcctttcaatattggcgccacacttcaatctctcccttctcttaatttcaattcctttcattttctggtaaagacaaaggagacatgttttatctgtggacccaaaactctggcaccggtcacggactaggaaggcagccttcccttggtgtttaatcattgcaagaacgcctctctgattattcacccacatttcagaggtgtcagaccatgcagggatgcttgccttggtccttcacccttagcggcaagtcccgcttttctaaggggcaagaatccccaatcccttatttccatgccccaacctcttatctctgtgcctcgatcccttatttccatgccccgacctcttatctctgcgccccatcccttatttccgtgccctgacctcttatctctgtgccccaaccccttatttttgcaccctgacccctttctggcttttctggaaggtaagaacccccaaaccccttccctctgtgtctctactctctcttttctctgggcttgcctccttcactataggcaaccttccatgctccactcctccatctcccttagcctgtgctctcaagaacttaaaacctctttgactcacacctgacctaaaacctaaatgccttgttttcttctgcaatgctgcttgaccccaatacaaactcaacagtggttccaaatagccagaaaacggcactttcaatttttccatcctgcaagatctaaataattcttgtcgtaaaataggcaaacagtctgaggtgcctgacgtccaggcattcttttacacatcggtccctccctagtctctgtgcccagtgcaactcgtcccaagtcttccttctttccgtctctcctgtcccctcagtcccatccccaagcgtccctgagtctttctaatcttccttttctacagacccatctgacctctcccctcctccccaggctgctgctcaccaggccgagctaggtcccaattcttcctcagcctccgctcctccaccttgtaatctttttatcacctcccctcctcacacccggtccagtttatagtttcattccgtgactagccctcccccacctgcccagcaatttcctcttaaaaaggtggctgaagctaaaggcatagtcaaggttaatgctcctttttctttatccgacctctcccaaatcagttagcatttagactctttcatcaaacatgaaaaacccagcccagttcgtggctcgttcggcagcaaccctgagacgctttacagccccaaaccctaagaggtcaaaaggctgtcttattctcaatatacattttattacccaatccactcctgacattaaataaaaccccaaaaattaaactccggccctcaaaccccacaacaggacttaattaacctcaccttcaaggtgtacaataataaagtagaggcagccaagtagcaatgtatttctgagctgcagttccttgcctccactgtgagacaaaccccagccacatctccagcacaaaagaactccaaacgcctgaaccgcagtggccagggattcctccagaacctcctccaccaggagcttgctacaagtgccggaaatctggccactgggccaaggaatgcccgcagcccaggattcctcctaagccgtatcccatctgtgtgggaccccactgaaaatcggactgttcaactcacctggcagtcactcccagagcccctggaactctggcccaaggctctctgactccttcccagatcttctcggcttagtggctgaagactgacactgcccgatcacctcggaagccccctagaccatcacggacaccgagcttcaggtaactctcactgtggagggtaagcccatccccttcttaatcaatatggaggctactcactccacattaccttcttttcaagggcctgtttcccttgcctccataactgttgtgggtattgatggccaagcttctaaaccccttaaaactccccgactctggtgccaacttaagacaatactcttttatgcactcctttttagttatccccacctgctcagttcccttattaggccgagacactttaactaaattatctgcttccctgactattcctaggtgacagccacaccacattgccaccttttcccccagttcaaagcctccttcacatcctccccttgtatctccccaccttaacccacaagtataagacacctctactccctccttagcgaccgatcatgcaccccttaccatcccattaaaacctaatcacccttaccccgatcaatgccaatatcccatcccacagcacactttgaaaggattaaaacctgttatcattctcctgttacagcatggccttttaaagcctataaaccctccttaccattccctcattttacctgtcctaaaaccagacgatgcttacaggttagttcaggatctgcgccttatcaaccaaattgttttgcctatccaccccgtggtgccaaacccatatactctcctatcctcaatacctccctctacaacccattattctgttctggatctcaaacatgctttctttactattcctttgcacccttaatcccagcctctcttcgctctcacttggactgaccctgacacccattaggctcagcaaattacctaggctgtactgccgcaaggcttcacagacagcccccattacttcaatcaagcccaaatttcatcctcatctgttacctatctcggcataattctcataaaaacacacgtgctctccctgctgatcgtgtctgattaatctcccaaacctcaatcccttacaaaacaacaactttccttcctaggcatggttagtgcagtcagaattcttacacaagagccaggaccgcaccctgtagcgtttctgtccaaacaacttgaccttactgttttagcctagccctcatgtctgcgtgcagcggctgccactgctttaatacatttagaggccctaaaaatcacaaactatacttaactcactctctacatttctcataacttccaaaatctatttgcttcctcatacctgacgcatatgctttctgctccccggctccttcagctgtactcactctttgttaagtcccacaattaccattgttcctggcccggacttcaatctggcctcccacattattcctgataccacacctgacctccatgactgtatctctctgatccacctgacattcaccccatttcccgatatttccttctttccttttcctcaccctgatcacgcttgatttattgatggcagttccaccaggcctaatcgccacacaccagcaaaggcaggctatgctatagtacaagccactagtccgcctcttagaatctctcatttcctttccatcgtggaaatctgtcctcaaggaaatcacttctcagtgttccatctgctattctactactcctcagggattattcaggccccctcgcttccctacacatcaagctcgaggatttgccccactcaggactggcaaattagctttactcaacatgccccgagtcagataactaaaatacctcttagtctaggtagacactttcactggataggtagaggcctttcctacagggtctgagaaggccaccgctgtcatttcttcccctctgtcagacataattcctcagtttagccttcccacctctatacagtctgataacagaccagcctttattagtcaaatcagccaagcagtttttcaggctcttggtattcagtgaaatctttatatcccttacagtcctccatcttcaggaaaagtagaacggactaaaggtcttttaaaaacacacctcaccaagctcagccaccaacttaaaaaggacggacaatacttttaccactttcccttctcagaagtcagacctgtcctcagaatgctacagggtacagcccatttgagctcctgtatagatgctccttttt

SEQ ID NO: 381 - DNA, 6437 bp, Homo sapiens
gtcaggcctctgagcccaagctaagccatcatatcccctgtgacctgcacatacgcatccagatggccagttcctgccttaactgatgacattccaccacaaaaggagtgaaaatggcctgttcctgccttaactgatgacattatcttgtgaaattccttctcctagctcatcctggctcagaagctcccctactgagtaccttgtgacccccactccttcccgccagagaacaacccccttttgactataattttcctttacctacccaaatcttataaaaccgccccatccctatctcccttcactgactctctttttggactcagcccgcctgcccccaggtgattaaaaagctttattcctcacacaaagcctgtttggtggtctcttcacacgaacacgagtgaaatttggtgctatgacttggatcgggggacctcccttgggagagcaatcccctgtcctcctgctctttgttccatgagaaagatccacctacgacctctggtcctcagaccaaccagcccaaggaacatctcaccaactttaaatctggtaagcggcttctttttactctcttctccaacctctctcactatccctcaaccgctttctcctttcattcttggcaccacacttcaatctctcccttctcttaatttctgttcctttccttttctggtagagatgaaggagactcattttatccatggacccaaaactctggcaccagtcacagactcgaagacagtcttctcttggtgtttaatcatgtggggacgcctgcctgattatttacccacgtttcagaggtgtctgaccacatggggacgcctgccttggtcctgcacccttagtggcaagtaccacttttctggggggcaagaacccctccaaccccttctccttcacccttagtggcaagtaccacttttctggtgggcaagaaccccccaaccccttctccctcacccttagcagcaagtactgcttttctgggggacaagaaccccccaacccattctccttcaaccttggaggcaagtaccacttttctagggggcaagaaacccccgaccccttctctctgtgtctctactctctcttttctctgggcttgcctccttcactatgggcaggcttccgccctccattcctccttcttctcccttagcctgtgttcttcaaaacctaaaacctcttcaactcacatctgacctaaaacctaaatgccttatttacttctgcaatgccgcttgaacccaatacaaacttgacagtggttccaaacagccagaaaatggcactttcaattttttccatcctacaagatctaaataattcttgtcgtaaaatgggcaaacggtctgtggtgcctgacgtccaggcattctttcacttatcggtccctccctagtctctgttcccagtgcaacttgtcctaaatcttccttctttccctcctgcctgtcccctcagtcccaaccccgagcgtcactgagtctttctaatcttccttttctacagacccatctgacctctcccctcctcaccaggccgagctaggtcacaattcttcctcaacctccactcctccaccctataatccttttatcacctcccctcctcacacctggtccggcttacagtttcgttccgcgactagccctcccccacctgcccagcaatttcctcttaaaaaggtggctggagctaaaggcatagtcaaggttaatgctcctttttctttatcccaaatcggatagcatttaggctctttttcatcaaatataaaaccccggcccagttcatggctcatttggcagcaaccctgggatgctttacagccctagaccctaaaaggtcaaaaggccgtcttattctcaatatacattttattgcccaatccgctccggacattaaataaaactccaaaaattaaattccagccctcaaaccccacaacaggacttaattaacctcgccttcaaggtgtacaataatagagtagaggcagccaagcagcaacatatttctgagttgcgattcctcgcctccactgtgagacaaaccccagccacatctccagcacacaagaacttccaaacgcctaaaccgcagtggccaggtgttcctccaggcccgcctccccccaggagcttgccccaactgccagaaatctggccaccaggccaagggatgcctgcagccagggatttctcctaagccatgtcccatctgtgtgggaccccactgaaaatcggactgttcaactcacctggcagccactcctagaccccctggaactctggcccaaggctctccgactgactccttcccagttcttctcgacttagtggctgaagactgacactgcccgatcaccttggaagccccctagaccatcacggatgccgagctttgggtaactctcacagtggagggtaagtctgtccccttcttaatcaatatgaaatctacccactccacattaccttcttttcaagggcctgtttcccttgcctccataactgttgtgggtattgatggccaggcttctaaatctcttaaaactccccaactctggtgccaacttagacaatattttttaagcactcctttttagttatccccacctgcccagttcccttattaggcccagacactttaactaaattatctgcttccctgactattcctggactacagccgcatctcattgctgcccttcttcccaatccaaagcctcctttgcatcttcctcttgtatacctccaccttaacccacaggtatggggtacctctactccctccttgacgaccaatcatgcaccccttaccatctcattaaaacctaatcaaccttaccccgctcaatgccaatatcccatcccacagcatgctttaaaaggattaaagtctgttatcactcacctgctacagcatggccttttaaagcctacaaactccccttacaattcccccatttttcctgtcctgaaaccagacaagttttacaggttagttcaggatctgcgccttatcaaccaaattgttttgcctatccacactgtggtgccaaacccatatactctcctatcctcaatacctccctccacaacccattattctgttctggatctcagacatgctttctgtactattcctttgcacacttcatcccagcctctcttccctttcacttggactcaccctgacacccatcaggctcagcaaattacctgggctgtactgctgcaaggcttcacagacagcccccattacttcagtcaagcccaaatttcttcctcatctgttacctatctcagcataattctcacagaaacacctgtgctctccctgccgctcatgtccaactgatctctcaaaccccagcatcttctacaaaacaactcctttctttcctaggcaaggttagatactttcgactttagatacctggttttgccatcctaacaaaaacattatataaactcacaaaagggaacctaaatgaccccatagatcttaaatcctttccccactcctctttccattccttgaagacagctttagagactgcccacaccctagcttttcctgactcatcccaacccttttcattacccacagctgaagtgtagggctgtgcagtcagaattcttacacaagaaccgggactgcaccctgtagcctttttatccaaacaacttgaccttactgttttgcctagctctcaagtctgcgtgaggcagccaccaccaccgtaatacttttagaagcccttaagatcccaaactatgctcaactcactctctacagttctcataacttccaaaatctattttcttcctcatacctgacacatatactttctgctcctcggctccttcagctatactcactctttgctgagtctcccacaattaccattgttcctggcaagaacttcaatccggcctcccacattattctggataccacacccgaccttcatgactgtatctctttgatccatctgacattcaccccatttccccatatttccttctttcctgttcctcaccctgatcacatttggtttattgatggcagttccacaaggtctaatcgccactcaccagcaaaggcaggctatgctatagtatcatccacatctatcattgaggctaccgctgtggccccctccactacctctcagaaagccgaactagttgccttaactcaagccctcactcttgcaaaagaactatgcatcaatatttatactgactctaaatatgcctttcatattctgcaccaccatgttgttatatgggctgaaagaggtttcctcactatgcaaaggtcctccatcattaatgcctctttaataaaaactctgctcaaggctgctttacttccaaaggaagctggagtcattcactgcaaaggccatcaaaaggcgtgagatcccattgctctaggcaacgcttatgctgataaggtggctagacaagcagctagctttccaacttctgtccctcacggctagtttttctccttcacatcggtcgctcccacctactcctccgctgaaacttccacctatcaatctcttcccacacaaggcaaatggttcttagaccaaggaaaatatctccttccagcctcacaggcccattctattctgtcataatttcataacctcttccttgtaggttacaagccactaggcagtctcttagaacctctcatttcctttccatcctggaaatctatcctcaaggaaattacttctcagtgttccatctgctattctactaccccgcagggattgctcaggcctcctcccctccctacacatcaagctcagggatttgcccccgcccaggactggcaaattgactttactcacatgcccccagtcagaaaactaaaatacctcttagtctgggtagacactttcactggatggatagaggcctttcctacagggtctgagaaggccaccacggtcatttctttccttctgtcagacataattccttggtttggccttcccacctctatacagtttgatagcagaccggcctttattagtcaaatcagccaagcattttttcaggctcttggtattcagtgaaacctttatatcccttatggtcctcagtcttcaggaaaggtagaacagactaatggtcttttaaaaacacacctcaccaagctcagccaccaacttaaaaaggactggacaatacttttaccactttcccttctcagaattcaggcctgtcctcggaatgctacagggtacagcccatttgagctcctgtatggacgctgttttttattaggccccagtctcattccagacaccagaccaacttggactgtgccccaaaaaacttgtcatccctactatcttctgtctggtcatactcctaattcacctttctcaactactcatacatgccctgctcttgtttacactgctggttttcactgtttctccaagccatcacagctgatatctcctggtgctatccccaaactgccactcttaactcttaaagtaaataaataatctttgctggcaggactatgctgaatctccttaggcactctctaattagatgtcctgggtcctcccaattcttagacttttaatacctgtttttctctttctcttattccatttagtttttcaattcatacaaaactgtaaccaggccatcaccaataattctaaatgacaaatgtttcttctaacaaccccacaatatcacccacaatatcaccccttaccacaaaatcttccttcagcttaatctctcccactctagcttcccacgctgcccctaatcccacttgaagcagccctgagaaacatcgcccattgtctctccataccacccccaaaaattttcaccatcccaacactttaccactattttgttttatttttcttatttatataagaagacaggaatgtcaggcctctgagcccaagctaagccatcatatcccctgtgacctgcatgtacacatccagatggccagttcctgccttaactgatgacattccaccacaaaagaagtgaaaatggccagttcctgccttaactgatgacattccaccacaaaagaagtgaaaatggcctgttcctgccttaactgatgacgttatcttgtgaaattccttctcctggctcatcctggctcaaaagctcccctactgagcaccttgtgtcccccactccttcccaccagagaacaacccccctttgactgtaattttcctttacccacccaaatcttataaaacggccccaccccatctcccttccctgactctcctttcggactcagcctgcctgcaccaaggtgattaaaaagctttattactcacacaaagcctgtttggtggtctcttcacacggacgcgagtgaaa

SEQ ID NO: 382 - DNA, 359 bp, Homo sapiens
gtcaggcctctgagcccaagcctgcacgtatatatccagatggtctgaagcaacagaagaatcacaaaagaagtgaaaatggccagttcctgccttgactgatgacattaccttgtgaaattccatctcctggctcagaagcacccccactgagcaccttgtgacccccacccctgcccgcaagaacacaaccccctttgactgtaattttccactacctacccaaatcctataaaactgcccacccctaactccctttgctgactcctttttggactcagcccgcctgcacccaggtgaaataaatagctttattactcacacaaagcctgtttggtggtctcttcgcacggacgcgc

SEQ ID NO: 383 - DNA, 4163 bp, Homo sapiens
cttctcccttagcctgtgttctcaagaatttaaaacctcttcatctcacacctgacctaaaacctaaatgccttattgtcttctgcaatgccgcttgaccccaatacaaacttaacaatggttccaaatagccagaaaatggcactttcaatttttccatcctacaagatctaaataattattgccgtaaaatgggtaaacggtctgtggtgcctgatatccaggcattcttttacacatcagtccctctctagtctctgttcccaatgcgattcctcccaaatcctccttctttccctcccgcctgtcccctcagtcccaaccccaagtgtcgccgagtctttctaatcttccttttctacagacccatctgacctctcccctccttgccaggccaagctaggtcccaattcttcctcagcctctgctcctccaccctataatccttttatcacctcccctcctcacaccgggtctggcttacagtttcgttccgtgactagccctcccccacctgcccagcaatttactcttaagaaggtggctggagctaaaggcatagtcaaggttaatgctcctttttttttttatcccaaatcagatagcatttaggctctttttcatcaaatataaaaatccagcccagttcatggctcatttggcagcaaccctgagacgctttacagccctagaccctaaaaggtcaaaaggccgtcttattttcaatatacattttattatccaatctgcgcccgacattaaataaaactccaaaaattaaattccagccctcaaaccccacaacaggacttaattaacctcgccttcgaggtgtacaataatagaggcagccaagtagcaacatatttctgagttgcaattccttgcctccactgtgagacaaacccgagccacatctccagcacacaagaacttccaaacgcctgaaccgcagcagccaggcattcctccagaacctcctcccccagtagcttgctacaagtgccagaaatctggccaccgggccaaggaatgcccacagcccgggattcctcctaagccacatcccatctgtgcaggaccccactgaaaatcggactgttcaactcacctggcagccactttcagagcccctggaactccggcccaactctctctgactccttcccagatcttctcagcttagcggctgaagactgacactgcccaatcgtctcggaagctcctagaccaacaccgacaccgagctttaggtaactctcacagtgaagggtaagtccatccccttcttaatcaatacgaaggctacccactccacattaccttcttttcaacagcctgtctctcttgcctccataactgttgtgggtattgaaggccaggcttctaaacctcttaaaactccccaactctggtgccaacttagacaatactcttttaagcactcctttttagttatccccacctgtccagtttccttattaggctgagacactttaactaaattatctgcttccctgactattcctggactacagccacatctcattgccgcacttcttcccaatccaaagcctcctttgcgtcttcctctcatatccccccatcttaacccacaagtatgggacatctctactccttccctggcaacagatcacatgcccattaccatcccattaaaacctaatcacccttaccctgctcaacgccaatatcccatcccacagcacgctttaaaaggattaaagcctgttatcactcacctgttacagcatgggcttctaaaacctataaactctccttacagttcccccattttacctgtccaaaaaccggacaagtcttacagattagttcaggatatgcgccttatcaaccaaattgttttgcctatcaaccctgtggtgcccaacctgtacattcttttgttctcaatacctccctccacaactcactattccattcttgatcttaaagatgcttttttcacaattccactgcacccctcatcccagcctctctttgctttcagactgaccatgacacccatcagtcccagcagcttacctgggctgtgctgctgcaaggtttcatggacagccctcattacttcagccaagctgtttctcgtgatttactttctttccacccctctgcttctcaccttattcaatatattgatgaccttcttctttgtagcccctcctttgaatcttctcaacaagacatacttctgctccttcagcatttattctccaaaggatatcaggtatccccctccaaagctcaaatttcttctccatccattacctacctcagcataattctacataaaaacacaagtgctctcaaaccccaaccccttctacaaaaaaacaactcctttccttcctgggcatggttggatactttcgcctttggatacctggttttgccatcctaacaaaaccattatataaactcacgaaaggaaacctagctgaccccatagatcctaaatcctttccccactcctctttgcattccttgaagacagctttagagactgcccccgccctagctctccctgactcatcccaacccttttcattacacacagctgaagtgcagagctgtgcattctaacacaaggaccaggattgtgtcctgtagcctttctgtccaaacaacttgaccttactgttttagcctagccctcatatctgcgtgcagtggctgccgctgctttaatacttttacaggccctcaaaatcacaaactatgctcaactcactctctacagctctcataacttccaaaagctattttcttcctcacacctgatacatatactttctgatccccagctccttcagctgtactcactctttgttaagtcccacaattaccatttgcccaggactggcaaattagctttactcaacatgcaccgagtcagaaaacaaaaatacctcttagtctaagtagacattttcactggataagtagaggtctttcctacaaggtctgagaaggccaccacagtcatttcttcccttctgtcagacataattcctcggtttagccttttaccaccttcccttctcagaattctgacctgtccttggaatgctacaaggtacagcccatttaagctcctgtatagacactcttttttattaagccccagtctcattccagacaccagaccaacttggactgtgccccaaaaaacttgtcatccctactatcttctgtctagtcatactcctattcactgttctcaactactcatatatgccctgctcttgcttacactgccagtttacactgtttctccaacccatcacagctgatatctcctggtgctatccccaaactgccactcttaaatcatctttgctggcaggactatgctgaatctccttaggcactctctaattagatgtcctgggtcctcccaattcttagatctttaatacctgtttttctccttattccgtttagtttttcagttcatacaaaaccatatcttctaacagtcccacaatatcaccccttaccacagaatcttccttcagtttaatctcttccactctaggttcccatgccacccctaatcctgcttgaagcagccctgagaaacatcgcccattatctctccatagcatcccccaaaatttttgccatcccaacactttaccactatttcgttttgtttttcttattaatataagaagacaggaatgtcaggcctctgagcccaagctaagccatcatatcccctgtgacctgcacgtacacattcagatggccagttcctgccttaactgatgacattccaccacaaaagaagtgaaaatggcctgttcctgccttaactgatgacattgtcttgtgaaattccttctcctggctcatcctggctcaaaacctcccctactgagcaccttgtgacccctactcctgctcgacagagaacaacccccctttgactgtaattttcctttacctacccaaatcttataaaacggccccacccctgtctgtctttgctgactctctttgctgactctctttgctgactctcttttcggactcagcctgcctgcacccaggtgattaaaagctttattgctcacacaaagcctgtttggtggtctcttcacacggacacgtatgaa

SEQ ID NO: 384 - DNA, 7295 bp, Homo sapiens
gtcaggcctctcagcccaagcctacaggtatacatccagatggcctgaggcaaccaaaaagtacaaaagaagtgaaacagccagctcctgtctttcttttcttttttttttttttttaaatgagacagagtcttgttctgtcgcccaagctggagtgcagtgacgtgatcttggctcactgcaagctccacctcctgggtttacgccattctcctgcctcagcctcctgagtagctgggactacaggcgcccgtcaccacacctggcaaattttttgcatttttagtagagacagggtttcaccatgttagccaggatggtctcgatctcctgacctcgtgatctgcccacctcggcctcccaaagtgctgggattacaggtgtgagccaccgcacccagcctccagcttctgtcttaactgattaaccaaccttatgacattccattatgacttgtttctgccctgtcccaactgatcgatagatcgacctcgtgacattcttctggacaatgagacttatgatctccccaccatgcactttgtgatccccacccctgcccgcaagagaaaaaccccctttaattgtaactttccactgcttaccccagtcctataaaactgccccatccctaactccctttgctgactcctttctcagactcagtccacttgcacccaagtgaataaatagccttgttgctcacacaaagccttttggtggtctcttcacatggacacgtgtgacattttggtgccgtgactcggatcagggtacctcccttgggagatcaatcccctgtcctcctgctctttgctccatgagaaggatccacctacgacctccagtcctcaaaccaaccagcccaaggaacatctcaccgattttaaatcgggtaagcagactctttttaccctcttctccaacctctctcgctatccctcaacttctttctcctttcaatttctgcgctacccttcaatctctcccttccctcaatttcagttcatttccttttctggtagaaacagaggagatgtgttttatctgtgaacccaaaactccggcactggtcaaggactcgggaagacagtcttcccttgttgtctaggtgtctaatcacagcggggatgcctgcctgattattcacccacgtttcagaggtgtctgatcaccacggggatgcctgccttgatccttcaccttggtggcaagtaccacctcctctgggtggcaagtaccacccccccaccccccgaagtgtctctaccctctcttttctctaggcttgcctccttcactatgggcaaccttccaccctccattcctccttcttcccccttagcctgtgttctcaagaacttaaaacctcttcaactctcgcctgacctaaaacctaagtgtcttattttcttctgcaacatggcttggcccaaatacaaacttgataatggctctaaatggcaaaaaaaaaaaaaaaaaaaaaaaaaaaaaaaaaaaaaaaaaccacggcacttttgatttctccatcctacaagatctagataatttttgtcaaaaaatgggcaaatggtctgaggtgccttacatccaggcatttttcacactttgttccctccctggtctctgctcccaatgtgactcgtcccaaatctttcttctttttctcctgtctgttccttcagtctccaccccaagctcttgagtcctttcaatctttcttttctacctacccatctgacctctcccctcctccccagacttctcctcttcaggtcgctctccgccagtctgaatcaggctcaaattcttcctcagcctctgctcctccaccctacaacccttctatcacctcccctcctgatacctggtctggcttacagtttcattctgtgactagctcttccccacctgcccaacaatttcctcttagagaggtggctggagctgaaggcatagtcagggtacatgtgcctttttctctatcagacctttcccaaatcagccagcttttaggctctttctcatcagacctcactaaatatatacaggaattccgatatctaactctgtcgtacaatttaacctggagtgacttaaatgtcatcctaacttctaccctctccccacatgaacaggaaagagttttttctctagcccagtctcatgctgacaactgctggtgtcatgagccagacctccaagaaggcagtagagcagttctctaagcggatccccaatgaaactatcaggcagattccccaggtatagctaggcaagattacatggtttcctgcctagttgaagggcttaaaaaggcagcatacaaagctgttaattacgataaacttaaaaaaaaaacctacccaaggtaaagacgaaaacccagcccagttcatggctcatttggcagcaaccctgagacactttacagccctagaccctgaagggtcagaaggccgtctcattctcaatatacattttatcacccagtcagctcctgacatgaaaaaaaaaaaaaaaaaaagcttcaaaaattggaatctggccctcaaaccccacaacaggaattaatcaatctcaccttcaaggtgtacagtaatagagagcaggcagccagacggcaacacatttctgagttacgattacttgcctctgctgtgagacaaaatccagccgcacctccagcacataagaacttcaaaatgcctaaaccacagtggtcaggcattcctacaggacctcctccatcaggatcttgcttcaaatgccagaaatctggccactgggccaaggagtgcccacagcctgggattactcccaagccgtgtcccatctgtgcagggaccaactggaaatcagactgcccatcttgcctggcagccactcctagagtccctaaagctctgggccaaggctctctgactgactccttcccagatctgctcggcttagcggctgaaaactgatgctgcctgatcacttcagaagccccctggaccatcacggatgccgagcttcgggtaactctcacagtgaaggctaagtccatcccctgtttaatcgatacaagggctacccactccacgttaccttcttctcaagggcctgtttcccttgcccccataactgttgtgggtattgatggccaagcttcaaaaccccttaaactcccccactctggtgccaacgtggacaacattcttttatgcactcctttttatttatttccacctgcccactttccttattatgtcaagacattctaactaaattatctacttccctgactattcctgggctagagccacacctcattgctgcccttttccccaattcaaagcctccttcacatcctccccttgtgtctccttaccttaatccacaagtataagatacctctactcctaccttggtgaccaatcatgcaccccttatgatcccattaaaacctaatcacccttaccccactcaatgccaatatcccatctcacagcaggctttaaaaaagttaaagcctgttatcactcacctgctacagcatgggcttctaaagcctataaactctccttacaattcccccattttacctgtccaaaaaccagacaagtcttacaggttagctcaggatctgcaccttatcaacaaaattgttttgcctatccacgctgtggtgcccaacccatacattcttttgtcctcaataccttcctccacaacgcactattccgttcttgatcttagaaacactttttcactattcccctgcacccctcgtcccaggccctctttgcttttacctggactgaccctgacacccatcagcctcagcaacttacctgggctatactgccgcaaggcttcagggacagcccccattacttcagtcaagcccaaatttcttcctcacccaattacctatcttggcataatttttcataaaaacacacatggtgtttatgtctggtgattatgtctggctaatctcccaaaccccaaccccttctataaaacaacaacttttttcctttctgggcatggttggatactttcacctttggatacgtggttttgccatcctaacaaaaccattatataaactcacaaagaaaaacctagctgaccccatagatcctaaatcctttccccactcctgtttccattccttaaagacagctctagagactgctcccacactagctctgcctgacccatcccaacccttttcattacacacagctgaagtgcagggctgtgcagtcaaaattcttacacaaggactgggactgcaccctgtgggctttttgtccaaacaaattgaccttactattttaagctggccatcatgcctctgtgcggtggctgccaccaccctaatagttttacaggccctcaaattcacaaactatggtcaactcactctctacagttctcataacttccaaaatctattttcttcctcacacctgacgcatatactttctgctccctggctccttcagctatactcactctttgttgagtctcccacaattaccattgttcctggtctggacttcaatctggcctcccacattattccggataccactccgacccccatgactgtatctctctgatccacctgacattcactccatttacccatatttccttctttcctgttcctcaccctgatcatactcggtttattgatggcagttccaccaggcctaattgccactcaccagcaaaggcaggctatgctatagtatcttccacatctatcattgaggctaccactctgcccagctccactacctctcagcaatctgaactcattgccttaactcgggccctcactcttgcaaaaggactacacgtcaatatttatactgactctaaatatgccttccatatcctgcaccaccattgctgttatatgggctgaaagaggtttcctcactacgcaagggtcctccatcattaacgcctctttaataaaaactcttctcaaggctgctttacttccaaagagtcattcactgcaagggccatcaaaaggcatcagatcccatcgctcaaggcaacagttatgctgataagacagctaaacaagcagctagcattctaacttctgtccttcgtggccagtttttcttcctcttatcagtcactcccacctactctcccactaaaacttccacctgtcagtctcttcccacacaaggcaagtggttcttagaccaagaagaatatctccttccagcctcacaggcccattctattctgtcatcatttcataacctctttaatgtaggttacaagccgctagcccatctcttttgtttttgtttttgtttttgagacagagtctcgctctgttggctaggctggagtgcagtgacacgatcttggctcactgcaagctccgcctcccgggttcacgccattctcccgcctctgcctccccagtagctgggagtacaggcacccaccaccacgctcagctaatttttttgtgtttttagtagagatggggtttcaccatgttagccaggacggtctcaatctcctgaccttgtgatctgcccacctcggcctcccaaagtgctgggattacaggtgtgagccaccacgcccggccctagcccgtctcttaaaacctcttattttgtttccattgtggaaatctatcctcaaaaaagtcacttctcagtgttctatctcctgttctactactcctcagggattgttcaggccccctcccttccctacacatcaagctcagggatttgcccctgcccaggactggcaaattgacttactcacatgccctgagtcaaaaaactaaaatacctcttggtctgggtagacactttcactggatgggtagaggcctttcccacagggtctgaaaaggccaccgcggtcatttcttcccttctgtcagacataattcctcagtttggcctttccatctctatacagtccgataacagactggcctttattagtcatatcacccaagcagtttctcagactcttgatattcagcaaaaccttcacaccccttaccgtcctcaatcttcaggaaaggtaaaatggactaatggtattttttttttttttgagacagagtcttgttctgtctcccaggctggagtgcagtggcccagtctctgctcactgcaagctctgcctcccaggttcacaccattctcctgcctcagcctcccatgtagctgggactacaggtgcccgccaccacacctggctaattttttgtattttttttagtagagacagggtttcaccatgttagccaggatggtcttgatctcctgacctcatgatccgcccgcctcggcctcccaaagtgctgggattacaggtgtgagccaccgcacctggccagactaatggtattttaaagacacacctcactaagctcatccttcaacttaaaaaggactggacagtatttttacctgttgcccttctcagaattagagcctgttctcgagatgctacagggcacagtccatttaaacttttatatggacgtactttcttgttcagccccagcctcgtcccagacaccagccctctaggtgactatcttccagtcctcaagcaggctagacaggaaattcgccaggctgctaatcttctcttgcctactccagattcccagacatataaagacaccctagctggacgatcagttcttattaaaaatctgacccctcaaactctacaacctcgatggactggaccctacttagtcatctatagcaccccaactgccatccgcctgcaggaccctccccattgggttcaccattccagaataaagctgtgtctgtcagccagccagcctgatctctcttcttcctcctggaagtcggaagtactctcccctacttcccttaaactcactcgcatttctgaaaaacagtaataacccttatgagcctaatacatcccttcattcttttaagtctattcatccttaccctactttttgcaacagggctatacgcagtcacccccactacttggactatgccccaaaaacttgtcatccctactatcttctgtgtagtcatactcctattcaccattctcaactactcataaatgccctgcccttgtttacactgccagtttacacttttcctccaaaccatcataactgatatctcctggttttatctcaaactgccacccttaaatctctcttgaagtaaataaaagatcttcagtggcaaggtacactccaatactttcaccctgatgaagtcctattctct

SEQ ID NO: 385 - DNA, 2692 bp, Homo sapiens
agtcacatggatggataatcctattgaagtatatgttaatgatagtgtatggggtacctggccccacagatgatcgctgccctgccaaacctgaggaagaagggattatgataaatatttccactgggtatcgttatcctcctatttgcctagggagagcaccaggatgcttaatgcctgcagtccaaaattggttgttagaagtacctactgtcagtcccatcagtagattcacttatcacacggtaagcaggatgtcactcaggccacgggtaaataatttacaagacttttcttatcaaagatcattaaaatttagacctaaagggaaaccttgccccaagaaaattcccaaaggatcaaaaaatacagaagctttagtttgggaagaatgtgtggccaatagtgcggtaatattacaaaacaatgaatttggaactattatagattgggcaccttgaggtcaattctaccacaattgctcagggcaaactcagtcatgtcccagggcacaagtgagtccagctgttgaaagtgacttaacagaaagtttagacaaacataagcataaaaaattacagtctttctatccctgggaatggggagaaaaaggaatctctaccccaagaccaaaaataataagtcctgtttctggtcctgaacatccagaattatggaggcttactgtagcctcataccacattaggatttggtctggaaatcaaactttagaaacaagagatcatcagccgttttatactatcgacctaaattccagtctaacggttcctttacaaagttgtgtaaagcccccttatatgctagttgtaggaaatatagttattaaaccagactctcaaactataacctgtaaaaagtagatagtttacttgcattgattcgacttttaatcggcagcaccgtattctgctggtgagagcaagagagggcgtgtggatccctgtgtccatggaccgaccgtgggaggcctcgccatccgtccatattttgactgaatattaaaagccattttaaatagatccaaaagattcatttttactttaattacagtgcttatgggattaattgcagtcacagctacggctgctgtggcaggagttgcgctgcactcttctgttcagtcagtaaactttgttaatgattggcaaaaaaatgctacaagattgtggaattcacaatctggtattgatcaaaaattggcaaatcaaattaatgattttagacaaactgtcatttggatgggagacaggctcatgagcttagaacatcgtttccagttacaatgtgactggaatatgtcagatttttgtattacaccccaagttgtaatgagtctgagcatcactgggacatggttagacgccatctacaggcaagagaagataatctcactttagacatttccaaattaaaagaacaaattttcaaaacatcaaaagcccatttaaatttggtgccaggaactgaggcaatcgcaggagttgctgatggcctcacaaatcttaaccctgtcacttgggttaagacgattggaagtactacgattataaatttcatattaatccttgtgtgcctgttttgtctgttgttcaagtctgcaggtgtacccaacagctctgaagagacagcgaccatcaagaacgggccatgatgatgatggcagttttgtcgaaaagaaaagggggaaatgtggggaaaagagagatcagattgttactgtgtcgtgtagaaataagtagacataggagactccattttgctctgtactaagaaaaattattctgccttgagatgctgttaatctataaccttacccccaaccccgtgctctctgaaacatgtgctgtgtccactcagggttaaatggattaagggcggtgcaagatgtgctttgttcaacagatgcttgaaggcagcatgcttgttaagaatcatcaccactccctaatctcaagtacccagggacacaaacactgcggaaggccgcagggtcctctgcctgggaaagccaggtattgtccaaggtttctccccatgtgatagtctgaaatatggcctcgtgggaagggaaagacctgaccgtcccccagcccgacacctgtaaagggtctgtgctgaggaggattagtaaaagaggaaggcatgcctctttgcagttgagacaagaggaaggcatctgtctcctgcccgtccccgggcaatggaatgtcccctgggcaatggaatgtctcggtataaaacccgattgtatgttccatctactgagataggggaaaaccgccttagggctggaggtgggacatgcgggcaacaatactgctctgtaaggcattgagatgttttatgtgtatgcatatctaaagcacagcacttaattctttaccttgtccatgatgcagagacctttgttcacgtgtttatctgctgaccttctctccactattatcctatgaccctgccacatccccctctccgagaaacacccaagaatgatcaataaatactaagggaactcagaggctggcgggatcctccatatgctgaacgctggtcccctgggcccccttatttctttctctatactttgtctctgtgtctttttcttttccaagtctctcgttccacctaacaagaaacacccacaggtgtggagggacaacccaccccttca

SEQ ID NO: 386 - DNA, 666 bp, Homo sapiens
ttacagtaggcagctggtcagacatgagcagggcaggagagggccctcccaaccaggaatgtcaggcgaccatcagtgttggtcgggtggctgttaactgtctctctaaaataataattggtcacagccaacgccagggaaaggcagcctcccaacagacagaaaaatccttccccataagacctcaggcattgggtgagtgggctcaagcatgtgtattaaaaggcaaaattgtggagtgtaactggtctatggcctcctagggacatttgacaggtaagggaacaacgcctcaggtaagcaggcgcgcaactccagtaaacacatagcgcgtgctcctcccaagggctggcagccactgcacatgtggacagcccaccccaagggaagaatcaggggagaaggcaggccagaccccggaagcgtgccaacatataaaaccccaagtcgaaggtcaaaccacacacctgtccttcaagtcacctgcttggcccccttccaagcgtcctttccttcctttcattcctgctctaaagctttttaataaatgtcactcctgctctaaaacttgtctcggtctcttcttctgccttctgccccttggtcgaattctttcttctgaggaggtgagaattgcggctgccgcagacctgtacggatttgcca

SEQ ID NO: 387 - DNA, 4222 bp, Homo sapiens
gaactagttgccttaattcaagccctcactcttgcaaaaggactacgtgtcaatatctatactgattctaaatatgcctttcatattctgcaccaccatgcggtcatatgggctgaaagaggtttcctcactacacaagtgtcctccatcattaatgcctctttaagaaaactctgctcaaggctgctttacttccaaaggaagctggggtcattcactgcaaggggcatcaaaagacttcagatcccattgctctaggcaatgcttatgctgataaggtggctagacaagcagctagctctccaacttttgtccctcatggccagtttttctccttcacatccgtcactcccacctactccacagctgaaacttccacctatcaagctcttcccccgcaaggtaaatggttcttagaccaaggaaaatatctccttccagcctcacaggcccattctattctgtcgtcatttcataaccttttccatgtaggttacaagccactagcctgtctcttaggacctctcatttcctttccatcatggaaatctatcctcaaggagatcacttctcagtgttccatctgctattctgctacccctcagggattgttcaggcctcctccctttcctacacataaagcttggggatttgcccctgcccaggactggcaaattgactttactcacatgcctcgggtcagaaaactaaaatatctcttagtctgggtagacactttcactgggtgggtagaggcctttcccatagagtctgagaaggccaccgcggtcatttcttcccttctgtcagacataattccttggtttggccttcccttctctatacagtctgataacggaccagcctttactagttaaatcacccaagcagtttctcaggctcttggtattcagtggaaccttcatatcccttaacatcctcaatcttcaggaaaggtaaaaccgactaatggtcttttaaagacacacctcaccaagctcagcctccaacttaaaaaggattggacagtacttttacctctcgcccttctcagaattagaacctgtcctcgagatgctacagggtacagtccatttgaacttttatatggacgcactttcttgcttggtcccaacctcatcccagacaccagccctctaggcgactatcttccagtcctccaacaggctaggcaggaaagtcaccaggctgctaatcttctcttgcctactccagatccccagccatatgaagacactctagctggacgatcagttcttgttaagaatctgacccctcaaactctacaacctcgatggactggaccctacttagtcatctatagtaccctgactgccgtccgcctgcaggatcctccccactgggttcaccattccagaataaagctgtgtccattggacagccagcctaatccctcctcttcctcctggaagtcgcaattactctcccctacttcccttaaactcactcgtatttctgaagaacagtaataacccttatgagcctaatacatcccttcattctattaggtctgtttgtccttgccctactttttgcaacagggctttatgaactcacccccaccacttaggctgagcccaaaaaatcttgtcatccctactattttctgtccagtcatactcctattctctgctctcaactacttataaatgccgtactcttgtttacactgctggtttacactgtttcttcaagccatcacagctgatatctcttggtgctatccccaaaccgccactcttaattccctcttagagtgggtagatgatctttgctggcagggcaccctccaatacttccaccctgatgaagttctattctttacttttatactctctcttattctcattcccattcttatgccaccttttgcctctccccagctatctccaccacactatcaaccttacccattctctcctagctgcttctaatccctccttagtgaacaactgctggctttgcatttccctttcttccagtgcctacatagctgtccctgccttacagacagactgggctacatctcctgtctccttacacctctgaacttcctttaacagccctcacctttaccctcctaaggaactcatttactttctagacaggtccagcaagactttcccagacatttcacatcagcaagctgccgccctcctccgcacttatttaaaaaacctttctccttatattaactctactccccccatatttggacctctcacaacacaaactattattcctgttgctgctcctttatgtatctcttggcaaagacccactggaattcccctaggtaatatttcaccttcttgatgttcctttactctttatctccaaagcccaactacacacatcactgaaacaattggagccttccagctccatattacagacaagccctctgtcaatactgacaaactcaaaaacattagcagtaattgttgcttaggaagacacttaccctgtatttcactccatccttggctaccttccccttgctcatcagactctcctcccaggccctcttcttgtttacttatacccagcccccaaaataacagtgaaaggttgctcatagataatcaacgttttctcgtacatcatgaaaattgaacatcctcctctatgcagttaccccatcagtccccattacaacctctgacagctgccgccctagctggatccctaggagtctgggtacaagacacccctttcagcactccttttcacttttttactttacatctccagttttgcctcacacaaggtctcttcttcctctgtggatcctctacctacatgtgtctacctgctaattggacaggcacatgcacactagttttccttacccccaaaattcaatttgccagtgggactgaagagctccctgttcccctcatgacaccgacatgacaaaaaagggttattccactaatttccttgatggttggtttaggactttctgcctccactgttgctctcggtactggaatagcagtcatttcaacctctgtcacgaccttccgtagcctgtctaatgacttctctgctagcatcacagatgtgccacaaactttatcagtcctccaggctaaagttgactctttagctgcagttgtcctccaaaaccgctgaggccttgacttactcactgctgaaaaaggaggactgtgtatattcttaaatgaagactgttgtttttacctaaaacaacctggcctggtgtatgacaacataaaaaaactcaaggaaagagaccaaaaacttgccaaccaagcaagtaattacgctgaatccccttgggcactctctaattgcatgtcctgggtcctcccaattcttagtcctttaatacccatttttctccttcttttattcggaccttgtatcttccatttagtttctcaattcatccaaaactgtatccaggccatcaccaatcattttatacgacaaatgtttcttctaacaaccccacaatatcaccccttaccacaagatctcccttcagcttaatctctcccactctaggttcccatgccacccctaataccgcttgaagcagccctgagaaacatcacccattctctctctccataccaccccccaaaaattttcactgccccaacacttcaacactattttatttttcttattaatataagaaggcaggaatgtcaggcctttgagcccaaatcaagccatcgcatcccctgtgacttgcatgtatacgcccagatggcctgaagtaactgaagaatcacaaaagaagtgaatatgccctgccctgccttaaatgatgacattccacaacaaaagaagtgtaaatggccggtccttgccttaactgatgatattccaccacaaaagaagtgaaaatggcccgtccttgccttaagtgatgacatcaccttgtgaaagtccttttcctggctcattctggctcaaaaactcccccactgagcaccttgtgacccccactctgcccaccagagaacaactccactttgactgtaattttcctttacctactcaaatcttataaaatggccccacccctatctccctttgctgactctctttttggactctgccggcctgcacccaggtgaaataaacaggcatgttgctcacacaaagcctgtttggtggtctcttcacacagacgtctatgaaa

SEQ ID NO: 388 - DNA, 5757 bp, Homo sapiens
gtcaggcctctgagcccaggccaagccatcacatcccctgtgacttgcacatatacgcccagatggcctgaagtaactgaagaatcacaaaagaagtgaatatgccctgccccaccttaactgatgacattccaccacaaaagaaatgtaaatggctggtccttgccttaagtgatgacatcaccttgtgaaagtccttttcctagctcatcctggctcaaaaagcacctccaatgagcaccttgtgacccccgcccctgcccaccagagaacaaccccctttgtaattttccattaccttcccaaatcctataaaatggccccacccctatcgcccttccctgactctcttttcggactcagcctgcctgcacccaggtgaaacaaacagccatgttgctcacacaaagcctgtttggtggtctcttcacacggacgcgcatgaaatttggtgccgtgactcggatcgggggacctcccttgggagatcaatcccctgtcctcctgttctttgctctgtgagaaagatccacctatgacctcaggtcgtcagaccgaccagcccaagaaacatctcaccaatttcaaatacggtaagcggactctttttactctcttctccaacctccctcactatctctcaacctctttctcctttcaatcttggcaccacaattcaatctctcccttctcttaatttcaattcctttcattttctggtagagacaaaggagacacattttatccgttgacccaaaactccggtgccggtcacggactgggaaggcagccttcccttggtgtttaatcattgcagggatgcctctctgattgtacacccacatttcaagggtgtcagaccacgcagggacacctgccttggtccttcacccttagcagcaagtcccacttttctggggaaggggcaagtaccccaaccccttctctccttatctctaccccttctccacttttctgggagaggggcaagtacccctcaacgccttctccttcacccttagtggcaagtcccgctttcctggggcaggggaaagtacccctcaacctcttctccttcacccttagtgtcaagtcccactttcctagggggcaagaaccccccaatcgcttatttctgcaccccaacctcttatctctgtgccccaatcccttatttccatgccccaaccccttctctgcttttctggagggctagaaccccccaccccttctccatgtctctactcttttccttgggcttgcctccttcactatgggtaagcttccaccttccattcctccttcttctcccttagcctgtcttctcaaaaacttaaaacctcttcaactcacacctgacctaaaacctaaatgacttattttcttctgcaatgctgcttgaccccaatacaaactcgacagtagttccaaatagccggaaaatggcactttcattttttccatcctacaagatctaaataattcttgtcgtaaaatgggcaaatggtctgaggttcctgacgtccaggcattcttttacacatcagtcccttcctagtctctgtgcccagtgcaactcgtcccaaaccttccttctttccctcccgcctgtcccctcagtcccaaccccaagcgtcgctgagtctttctaatcttccttttctacagacccatctgacctctcccctcctcaccagcccaagctaggtcccaattcttcctcagcctcagcccctccaccctgtaatctttttatcgcctcccctcctcacacctggtccggcttacagtttcgttctgtgactagccctcccccactacccagcaatttactcttaaaaaggtggctggagccaaaggcatagtcaaggttaatgctgctttttctttatcccaaatcagatagcgtgtaggctctttttcatcaaatataaaaacccagcccagttcatgtctccttcggcagcaaccctgagaggctttacaaccctagaccctaaaaggtcaaaaggccatcttattctcaatatacattttattacccaatctgctcccaacattaaataaaactccaaaaattaaattccggccctcaagccccacaacaggacttaattaacctcaccttcaaggtgtacaatcatagaaaaaagttgcaattccttgcctccactgtgagacaaaccccagccacatctccagcacacaagaacatccaaacgcctgaaccgcagcggccaggcgttcctccagaacctcctcccacaggagcttgctacacatgccggaaatctggccactgggccaaggaatgcccacagcccgggattcctcctaagccgcgtcccatctgtgtgggaccccactgaaaatcagattgttcaactcacctggctgccactcccagagcccgtggaactctcgcccaaggctgtctgactgactccttcccagatcttcttggcttagctgctgaagactgacactgccggatcgccttggaagccccctagaccatcacggacaccgagcttcgggtaactctcacagtggaaggtaagcccatccccttcttaatcaatacggaggctacccactccacattaccttcttttcaagggcctgtttcccttgcctccataactgttgtgggtattgacgaccaggcttctaaacctcttaaaactctccaactctggtgccaacttagacagtactcttttaagcactcctttttagttatccccacctgcccagttcccttattaggctgagacactttaactaaattatctgcttccctgactattcctggactacagccatatctctttgctgcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaatgccaatatcccatcctgcagcatgctttaaaaagattaaagcctgttatcactcgcctgctacagcatggcctttgaaagcctataaactctccttacaatttccccattttacctgtcctaaaaccagacaagccttacaagttagttcaggatctgcaccttatcacccaaattgttttgcctatccaccctatggtgccaaacccatatactcttctatcctcaatacctgcctctacaacccattattctgttctagatctcaaacatgctttctttactattcctttgcaccctaaatcccagcctctcttcgctttcacttggactgaccctggcacccatcaagctcagcaaattacctaggctgtactgctgcaaagcttcacagacagcccccattacttcaatcaagcccaaatttattcctcatctgttacctatctcggcataattctcataaaaacacatgtgctctccctgccaatcgtgtccgactgatctctcaaaccgaagcaccttctacaaaacaacaactcctttccttcctaggcatggttagcgtggtcagaattcttacacaagagccaggaccgcaccctgtagcctttctgtccaaacaacttgaccttactgttttagcctagccctcatgtctgcgtgcagcagctgccgctgctgtaatacttttagaggccctcaaaatcacaaactgtgctcaactcactctctacagttctcataacttccaaaatctattttcttcctcatacctgatgcatatactttctgctccccggctccttcagctgtactcactctttgttgagtctaccacaattaccattgttcctggcccggacttcaatccagcctcccacattattcctgataccacacctgaccctcatgactgtacctctctgatccacctgatattcacatttccccaaatttccttctttcctgttcctcaccctgaccacgcttgatttattgatggcggttccaccaggcctaatcgccacacaccagcaaaggcaggttatgctacagtacaagccactagcccgcctcttagaacctctcatttccttttcatcgtggaaatctatcctcaaggaaataacttctcagtgttccatctgctattctactactcctccgggattattcaggccccctcccttccctacacatcaagctcgaggatttgccccacccaggactggcaaattagctttactcaacatgccccgagtcagataactaaaatacctcttagtctaggtagacactttcactggataggtacaggcctttcctacagggtctgagaaggccatcacagtcatttcttccgtcctgttagacataattcctcagtttagccttcccacctcaatacagtctgataacagatgagcctttattagtcaaatcagccaagcagtttttcaggctcttagtattcagtgatacctttatatcccttatggtcctccgtcttcaggaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtcgcattccagacaccagaccaacttagactgtgccccaaaaacttgtcatccctactatcttctgtctagtcatactcctattcaccattctcaactactcatacatgccctgctcttgtttacacggctggtttacatggttttcccaagccatcacagctgatatctcctggtgctatccccaaactgccactcttaactcttgaagtaaataaataatctttgcaggcaggactatgctgaatctccttaggcactctctaatcagatatcctgagtcatcccaattcttagaccttttatacctgtttttctccttctgttattccatttagtttctcaattcatacaaaaccgtatccaggccttcaccaatcattctatacgacaaatgtttcttctaacatccccacaatatcaccccttaccacaagatctcccttcatcttaatctctcccactctacgttcccacgccacccctaatcccgcttgaagcagccctgagaaacatcgcccattctctctccataccaccccccaaaaattttcgccgccccaacacttcaacgctattttgttttatttttcttattaatataagaaggcaggaatgtcaggcctctgagcccaagccaagtcatcacatcccctgtgactttcacatatatgcccagatggcctgaagtaactgaagaatcagaaaacaagtgaatatgccctgccccaccttaactgatgacattccaccacaaaagaagtgtaaatggctggtccttgccttaactgatgacattaccttgtgaaagtccttttcctggctcatcctggctcaaaaagcacccccactgagcaccttgcgacccccacccctgcccaccagagaacagcgccctttgactgtaattttccattaccttcccaaatcctataaaacggccctgcccctatctcccttcgctgactctctttttggactcagcccgcctgcacccaggtgaaacaaacagccatgttgctcacacaaagcctggttggtggtctcttcacatggacgtgcgtgaaa

SEQ ID NO: 389 - DNA, 452 bp, Homo sapiens
ttagagtaggcagctaggcagacatgagaagggcaggagaggaggtttcccctgcccaattgccagcaatgttaggcaaccatcaggtgaaggtggttgttaaactgcctaaaataataattggtagtctcccaatagatgaaaaacacctgaagctggtgatcagcagcttcccaaaaagatctgaggatttgggcaagcaggcttaatcatgcacactaaggggcaaaatggcagagtttcactggtgtatgaccttcttctaggaacatttgactggtgtggggaaaaaatgcctcagatgagcacatcgcacaacttcagtaaacacactgctcatgtggcccctctcaagtgctgacaggccactgtgtgtttggacagcccccgcaaggaaagaatcaagggagaggaaacacaaaccctggaaccatgccagtgtataaaacccc

SEQ ID NO: 390 - DNA, 879 bp, Homo sapiens
aggcacccctacggaggaaatctcaactgcacaacccctactgtgccccaattcagcaggaagcagttagagcggtggtcaaacctccccaatagcacttgggttttcctgttgagagggggtactgagagacaggactagttggatttcctaggctggctaagaatccctaagcctagctgggaaattgaccacgtccacctttaaacacggggcttgcaatttagctcacacccgaccaatcaggtagtaaagagagctcactaaaatgctaattagggaaaaacaggaggtaaagaagtagccaatcatctatcgcctgagagcacaacaggagggacaatgatcaggatataaacccaggcattcaagccagcggtggctaccctctttgggtcccctccctttgtatggaagctctgttttcactctattaaatcttgcaattgcacacttttctggtacgtgtgtgtcacagctcaagctgagctttcgctcaccgtccaccactgctgtctgccgctgtcacagacccacagctgacttccatccctctggatccagcgaggcgcccattgctgctcctgatcgggctaaaggcttgcccttgttcctgcagggctaagtgcccaggttcgtcctaatctagctaaacactagtcactgggttccacgattctcttccatgacccacagcttctaatagagctataacactcgccgcttggcccaagattccattccttggaatccatgaggccaagaaccccaggtcagagaacacaagacttgccaccatctcggaagtggcccgtcaccatcttggaagcgacctgccaccatcttgggaacttggggagcaaggacccccagtaacat

SEQ ID NO: 391 - DNA, 5823 bp, Homo sapiens
gtcaggcctctgagtccaagccaagccattgcatcccctgtgacttgcacgtatatacccagatggcctgaagtaactgaagaatcacaaaagaagtgaaaagatcctgccccgccttaactgatgacattccaccattgtgatttgttcctgccccaccttaactgagtgattaaccctgtgaatttccttctcctggctcagaagctcccccactgagcaccttgtgacccctgcccctgcccaccagagaacaaccccctttgactgtaattttccattaccttcccaaatcctataaaatggccccaccccatctcccttcgctgactctctttccggactcagcccacctgcacccaggtgaaataaacagctttattgctcacacaaagcctgtttggtggtctcttcacacggatgcgcatgaaatttggtgccgtgactcggatcgggggacctctcttaggagatcaatcccccgtcctcctgctctttgctccatgagaaagatccacctatgacctcaggtcctcagaccgaccagcccaagaaacatctcaccaatttcaaatctggtaagcggcctcttttcactctcttctccaacctccctcactatccctcaacctctttctcctttcaatcttggtgccacacttcaatctctcccttctcttaatttcaattcctttcattttctggtagagacaaaggagacaccttttatccttggacccaaaactccggcgccagtcacagactgggaaggcagccttctcttggtgtttaatcattgcagggacacctctctgattattcacccacgtttcaagggtgtcagaccacgcagggacgcctgccttggtccttcacccttagtggcaagtcctgcttttctggggaaggggcaagtaccccaaccccttctctccttgtctctactccttctctgcttttctggggaaggggcgagtaccccaaccccttctctccttgtctctaccccttctctgcttttctggggaaggggcaagtaccccaaccccttctctccttgtctctaccccttctctgcttttctgggggagggcaagtacccctcaaccccttctccttcacccttagcggcaagtcccactttgctagggggaaagaacccccaatcccttatttccacaccccgacctcttatctctgtgccccaatcccttatttccacaccccgacctcttatctctgtgccccaatcccttatttccgcaccccaacctcttatctctgtgccccaattccttatttccatgccccaacacttcctctgcttttctggagggcaagaaacccctaccccttctccgtgtctctactcttttctctgggcttgcctccttcactatgggcaagcttcaaccttccattcctccttcttctcccttaacctatattcttaagaacttaaaacctcttcaactctcacctgacctaaaatctaagcatctcattttcttctgcaatgccacttgaccccaatacaaactcgatggtagttccaaatagccagaaaatggcactttcaatttttccatcctacaagatctaaataattcttgtcataaaatgggcaaatggtctgaggtgcctgacatccaggcattcttttacacatcagtcccttcctagtctctgtgcccagtgcaactcgtcccaaatcttccttctttccctcctgcctgtccccacagtcccaaccccaagcgtcactgagtctttctaatctcccttttctacagacccatctgacctctcccctcctcaccaggccaagctaggtcccaattcttcctcagcctctgctcctccaccctgtaatctttttatcgcctcccctcctcacacctggtcctgcttgcagttatgttccgtgactagccctcccccacctgctcagcaatttactcttaaaaaggtggctggagccaaaggcatagtcaaggttaatgctcctttttctttatcccaaatcagaagcgtttaggctctttttcatcaaatataaaaacccagaacagttcatggctcgttcggcagcaaccctgagacactttacagccctagaccctaaatggtcaaaaggccatcttattctcaatatacactttattacccaatctgctcccgacattaaataaaactccaaaaattagaatctggccctcataccccacaacaggacttaattaacctcaccttcaaggtgtacaataataataaaaaaaaaaagttgcaattccttgcctccactgtgagacaaaccccagccacatctccagcacacaagaacttccaaacccttgaactgcagcggccaggcgttcctccagaacctcctcccccaggagcttgctacaagtgccagaaatctgaccaccaggccaaggaatgcctgcagcccaggattcctcctaagctgtgtcccatctgtgcgggaccccactggaaatcggactgttcaactcacctggcagccactcccagagcccctggaactctggcccaaggctctctgactgactccttcttggcttagcggctgaagactgatgctgcctgattgcctcggaagccctgtagaccatcacagatgccgagctttaggtaactctcacagtggagggtaagtccgtccccttctaaatcaatacggaggctactcactccacattaccttcttttcaaggacctgtttcccttgcctccataactattgtgggtattgatagccaggcttctaaacctcttaaaactccccaactctggtgccaacttagacaatacgcttttatgcactcttttttagttatccccacctgcccagttcccttattaggccgagatattttaaccaaattatctgcttccctgactattcctggactatagctgcatctcattgccgcccttcttcccaatccaaaacctcctttgtgtcctcttcttgtattcccccaccttaacccacaagtataagatacctctactccctccttggcgaccaatcatgcacccttaccatctcattaaaacctaatcacccttaccccactcaatgccaatatcccatcccacagcatgctttcaaaggattaaagcctgttatcactcgcctgctacagcatggccttttaaagcctataaactctcccacaattcccccattttacctgtcctaaaaccagacaagccttacatgttagttcaggatctatgccttatcaaccaaattgttttgcctatccaccccatggtgccaaacccatatactctcctattctcaatacctccttccacaatccattattctgttctggatctcaaagatgctttctttactattcctttgcacccgtcatcccagcctctctttgctttcacttggactgaccctgacacccatcaggctcagcaaattacctgggctgtactgccacaaggcttcacagacagaccccattacttcagtcaggcccaaatttcgtcctcatctgttacctatctcaacataattctcgtaaaaacacatgtgctctccctgctgatcgtgtctgattaatctcccaaacctcaatcccttacaaaacaacaactcctttctttcctaggcatggttagtgcggtcagaattcttacacaagagccaggaccgcaccctgtagcctttctgtgcaaacaacttgaccttactgttttagcctagccttcatgtctgcgtgcagcggctgctgctgctttaatacctttagaggccctcaaactcacaaactgtgctcaactcactctctacatttctcataacttccaaaatctattttcttcctcatacctgatgcatatactttctgctccctggctccttcagctgtactcactcttcattaagacccacaattaccattgttcctggccgggacttcaatccggcctcccacattattcctgataccacacctgacccccatgactgcatctctctgatccacctgatgttcatcccatttccccacatttccttcttccctgtttctcaccctgatcatgcttgatttattgatggcagttccaccaggcctaatcaccacataccagcaaaggcaggctatgctattgtataagccactagcccgcctcttagaacctttcattttctttccatcgtagaaatctatcctcaaggaaataacttcttagtgttccatctgttattctgtctgctattctactacacctcaaggattattcaggccccctcccttccctacacatcaagctcaaggatttgcccccacccaggactggcaaattagctttactccacatgccctgagtcacaaaaactaaaatacctcttagtctaagtagacactttcactagataggtagaggtctttcctacagggtctgagaagtccaccgcagtcatttcttcccttctgtcagacataattcctcagtttagccttcccacctctatacagtctgataacaggccagcctttattagtcaaatcagccaagcattttttcaggctcttagtattcagtgacagactaatggtctattaaaaacacacctcaccaagctcagccaccaacttaaaaaaggactggacaatacttttaccactttcccttctcagaagtcaggcctgtcctcagaatgctacaaggtacagcccatttgagctcctgtatagacgttcctttttattaggccccagtctcattccagacaccagacaaacttagactgtgcccccaaataacttgtcatccctactatcttctgtctagtcatactcctattcaccattctcaactactcatacatgccctgctcttgtttacactgccagtttacactgtttctccaagccgtcacagctgatatctcctcgtgctatccccaaactgccactcttaactcttgaagtaaataaataatctttgctggcaggactatgctgaccctccgtaggcactctctaattagatgtcctaggtcctcccaattcttagtccttttatacctgtttttctccttctcttattccatttagtttttcaattcatacaaaaccgtatccaggccatcaccaatcattctatatgataaatgtttcttctaacaaccccacagtatcaccccttaccacaaaatcttccttcagcttaatctctcccactctaggttcccacaccacccctaatcccgcttgaagcagccgtgagaaacatggcccattctctctccataccacccccaaaaattttcgccgccccaacacttcaacactattttatttttcttattaatataagaaggcaggaatgtcaggcctctgagcccaagccaagccattgcatcccctgtgacttacatgtatatgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctcccccactgagcaccttgtgacccccacccctgcccaccagagaaaaaccccctttgactgtaattttccattaccttcccaaatcctctaaaacagccccacccctatctccctttgctgactctcttttcagactcagcccacctgcacccaggtgaaataaacagctttattgctcacacaaagcctatttggtggtctcttcacacggacgcgcatgaaa

SEQ ID NO: 392 - DNA, 1025 bp, Homo sapiens
aaagaaagaaaagaaacaatgttttgtagggaaaagaaagagagttcagactgttactgtgtctatgtagaaaaggaagacataagaaactccattttgatctgtaccctgaacaattgttttgccctgagatgccgttaatttgtaactttagccccaaccttgagctcacagaaacatgtgttgtatggaatcaaggtttaaggatctagggctgtgcaggatgtgccttgttaacaatatgtttacaggcagtatgcttggtaaaagtcatcgccattctccattctccattaaccgggggcacaatgcactgcggaaagccgcagggacctctgcccacgaaaacctgggtattgtccaaggtttctccccattgagagaggctgagatatggcctcatgggaagggaaagacctgaccatccctcagcccaacacccgtaaagtgtctctgctgaggaggattagtaaaagaggaaggcctcttgcggttgagataagaggaaggcctctgtctcctgcatgcccctgggaacggaatgtctcggtataaaacctgattgtacattcgttctatactgagatagaagaaaaccaccctgtgtctggaggcgagatatgctggtgataattctgctctgttactctttactacactgagatgtttgggtggagggaagcataaatctggcctacatgcacatccaggcacagtcccttcccttgaacttatttgtgacacagattcctttgctcacatgttttttttgctgaccatctccccactatcaccctgttctcctgccgcattccccttgctgagatagtgaacatagtaatcaataaatactgagggaactcagagaccggggctggggtgggtcttccatatgctgagcgctggtctcctgggcccactgttctttccctatactttgtctctgtgtcttatttcttttctcagtctctcttcccacctgatgagaaatacccgcaggtgtggaggagcaggccacctcttca

SEQ ID NO: 393 - DNA, 473 bp, Homo sapiens
ttacagtaggtagctagtcaggcatgagcagggcaagagatggctctccccaacctccaccaggagtgtcaggcgaccatcaagtgatggtcaggcagtttaaaataatgattggtcgcagccagcgccagagaaggacagtctcccaacagatagaaaacacccaaaactggtgatcagcagcttccccataagatctcggaagctgggcgagtgggctcaagcatgtgcactaagaggcaaaatggcagagtttaactggtatatgaccttcctctaggaatgctagattggtaagggaagaatgcctcaggtgagcatgcgtacaactccagtaaacacactgtgcatgcaggccctcccaagtgctgaaaggccattgtgcatgcaggcagcccaccccaagggaagaactgggggagaaggagggcgcaagaccccagaagcatgccaacgtgtaaaaccccaagtca

SEQ ID NO: 394 - DNA, 6694 bp, Homo sapiens
gtaggagatcagtcagggtggtgggaaaaattgtagaaagatgtaaaccttcttggaaggctggaaggttttacaaaagcttcggaaaaagatttggctgaaggcagccagattgtcttatctggtgcctgaaactttaggttaggtaacaaggggatgtaaagaaactcatctaagtaagttagtttacttagaccatggaacctggcctaaatcatctgcatgcaagactagcggggggtgggggtgggcgcagcacgaccatgtgaattccccacaagtgtgttgactcaagacctttgtcattaaatctatactgaataaatgcccgcagcgcaagcacaggcttgtcagggcctcagccgctgactctttatacaccctcctcagtgtctgtgggcggcccagtcccctagcccactctttcactggcttcctgtgtctgagttcatttgttcatctgttgttcagccagggtctgcgggtcggacccggaaggtagagccctgtgtgaggaatgctgcaacagatcacaacagaacccttgaaaatgaaggtgaaaaaactgcggtcagtaagtcactgttgcctgctctgaatttccaagttcgagggaattgctcaggctagggtttcatcaagggacaacagttatcagctcaacagaaacagtatataaaagtatttaaaaagctgcttaaagctagtggagcctgggtttcacaggctcaattaagggacctaatgcaaactgttgtatcccataacccatggttcctggaagaaggtacactagccatagagctctaggaacaagtggggagaaatcttaaacatcatgcacaaggacaacaggtcccagtaacatctttaacattatgggctttagttagggcagctctggccccgttatacacagaagagcctaaaaaggggagggaggaggaaccatcatctaccttactgcctccttatccctcagccccgctatcaccgggccaaaataacaaagaggaaacggaggttttgcctgagccccctcctccaataaactagaagaaaagacaagggatatgctacagctgggggaccctgtcttaagcaagtggcattagaaggggagctcttagcctgcccagtaatgcaagaacgacaatgcaatcaggtacatgaacccatttcttttaatgcttataaaaagctaagaaaaagcattaaagaaaacagagccgctagcccatttccttacgaaaggaatgactgaagccttggcagacaacttccgtatgaccccatgggactggtcagtgctagctaaaacaattttggaggccagccagtacctcctctagagggcagaatacgatgagttgtgcgaacaacaagccaaccagaacgaggtggccgtgcaagatgtaacagctgctatgctccaggggaggcgtccccatgccgatgtacaacaactaattttgatccccaggcctatgcacaagtgtctttgtgcgctctcggggcttgggacagaatttccaaaagcagagatcaacagggatcttttataaatgttcgacaagggcctcaggagccatttgttgaatttatcaatcgtttaacccaggcaattaagagacaaattagtcacacccaggactgatatcttgttacaattggcttataaaaacgctaatgtggatcgccaacaagcaatgcatgcaatcagaggaaaggcagccacagtcagggaacttacacaagcatgtcaactggtggggactgaaacacacaaagccaaaatattggctatggcattaaggcctcctaaagtgaaaagggagggaaacccaaattgttttctatgtggagaggcaggtcatatgaagagggaatgtcccaataatagagaccaaggtaactcaggaaaagaacccccttctatatgactgcaatgtaaaaaggggaaacattgggcaaatcaatgcaagtccaaatttgataaaaacgacaactccgtaagtaaccaggcgggaaacttcatgaggggctgaccccaggccctgctgcaaactggggcaatgtcagtggctttcctctgtcagatggaaagcccacagtcctctctctcagagcaaccaccactgggagcgcaagactggacttactctgccccgatgaattagtgctaaaagaaggagaagacactaaaagggttgcaaccgggatctggggcccactgcctctgggaacagtgggattagtcctagggcaatctagcctatccagtaaaggaatcaatgtgctcactggggtaactgatagtgattattgaggtgagatactagttatgatggaatgtaaaggtctgcatatttcttcccccgggatcaaagacagctctgttactgcttttaccatactgggtccccaatgcccagaaagggggaaagggacgttttggaagcacaggagccacaaaagtacactggaatcaattaatcactaaccagagacccatgatcaccttaaaaattggaaataagaattttactggcttattggacacacggatggatatttcaaacattaatgatcaaaactagccagaaacttgtccttgggtcactcagaaacaaaaaattgttggcattggggaagcgcacacagccaagcagagcacgtgccccctaacctgttgcgattcagaggtaagaaaggcagttatacaacctcaactcatgcccttccctgttaacctttggggacgggacctattagcccaatgggggggtcactctgcagacctctttctaataatggccacagttattcctcccctacccttgacattgctctctcaaaatcctatttgggtagaatagtgatctttaaagggaaagaaattacaaacagcccgtgaattagttgaggggcaactaaaagccagccatacagaaccatcaaacagcccctggaattcacccattttcgtcattcccaaaaggtctggtaaatggagacttttgcacgacttatgtgctatcaatgctaatttgcaacctatggggccccttcagcaggggctcccctcccccacggccattcgacattggcctataatcgttactgacttaaaagactgcttttatactattcccctagcagaagaggacagagaagaatttgcatttacaataccagcaatcaataatgaaaggccagctccctgattccaatggaaagtgcttccccaaggaatgctgaacagtcctaccatgtgtcagtatcatgtaaatcaggctttctccccagtagaaaagaatttcctaatggcaagattattcattttatggatgatattttactagcagccccaacagagccagtgattttaaggttatataactctgtagcaaagaatacacagttaagaggtttaatcatagcacctgaaaaagtacagatgtcttctccttggaaatatcttggatacagactaatttcttgctaagacctcaaaagcttaaattagatactagcaacttacacaccttaaatgattatcagaaattactaggtgatattaactggctttgccccaccctaggcataactactgataagttacaaaacttgttttctatcttaaaaggcaatgctgccctagactctcctaggtatttaactcctacggcacaaagggaaattgaagaagtagagcaatttatctctcaaaggcaattagatcgcacagatccatgatattcagttcagctgtttgtttttcccactaaacactcccctacagggttaacaagacagatgggcccagagctatgctttctagaatgggttttttgctcacataccgggactaaaacactctctctctatgtccagtgagtcaataaagtcatctattcaggcctcagacaatgcaatcagttgctaggttatgaccctgatatcatcaggattcctttaagtaaaaagcaatttgaagcagtattacccttatctatggacctgcaaacagcactctctgattacacaggccttatagggcatacccttcctgctgacaaactccttcagttcttatctcgtacttctgttgttttgcctactaaaatagttcaatcccccatacctaatgctttaacattgtttactaatggctctggtaaacatggaaaagcggctgtctggtggagatcacataattccctcactcattctggatttactagcactcagagagctgagattggagccttaatattagccttagaaactttctccactcagctcatcgatattgttagtgactctgcttactgtttatttattgcagaactttgagacggccttcattaagaccactctggagcccaccctgtgtgcactttttctccgacttcagcaactgctagatcaatgtatacatcttatttttattacacacattcgggcccacagctcactgcctggcccactggcttatggcaatgatcaagcagacctacaggttatgacatcactgcctgaccaagccacccaattgcaacaatttttccaccaaaacttgagaaacttatctaaacaatttcaacttacccagagactagctaaacaaattaccctacaatgcccagattgccagttcacaggcacatcccctccttcaacaggtgttaaccctagaggactagaacctaatcagttttggcaaacagatgttacacgcatccctgaatttggaaaacgtagatatgtacatgtatccattgataccaattctcatttaattagtactcatgctcttcctggagagtccacccgatatgtcattaaacatcttcttttaacttttgcatttatgggacggcccacagaaattaaaactgataatggtctggcttatgccagctcacaatttcaacaattttgtcacacatggaacatccaacattccacaggcatcccgtataactcccaaggacaggccatagaacgtacccaatccagccttaaaaatatgctcagaaaacaaaaaagggggaatatgaataaggaccctgcaacactactagcacaagccttatttacccttaatttttaaaatttaaataaatttcaatcagctgtagaaaagcactttgctaaaacctctcaagaaataaaacctgcagttttatggaaagacgtaaacagtaatgtatggtatggtccaaatgaattgttaacgtgggggagaggatatgcttgtgttcacaccccctcaggtcctctttgtattccagcataatgcatcgaaccataccatggtgtggctaggacccaacccagtaccagaaataaagaaaataaccctatgggacccatagccccgaacaatgtggcttcatcagacaacacaggccccggacaggatgctcaagaagacaagtcagaagactgagtgaatcctgctctggacacagacaccattcactccagataatctgctccttgttatgctttattattatttatttatttatttattttttttttgagacagagtctcactctgtcaccaagctggagtgcagtggtgcgatctgggctcactgcaacctctgcttgccaggttcaagtgattatcctgcctcagcctcccaagtagctgagaccacaggcacatgccaccatatccagctaatttttgtatttttagtagagatggggtttcaccatgttagccaagatggtctcaaactcttgacctcgtgatccacctgcctcagcctcccaaagtgctgggattaattctctcactctgcctgcaactagtacctgctacactctatttggcccatcctctaaatccgcctttcttctgccctgttacttagacaaatacccgaccttcccagcttctaacaacgtgactgcttggctgagagagattaacataaccccagtggggttccttagtaacagcacacaatgaactgaactgctgagtaacaatataggtcactccttgattggaaaaaaaaaaatgttgattatactcaagtttgtcttatgttatttactaatgctaggatgcaaagctggaatatgagcagttaccaccacgcctgacaaacctactgcacatatctgtactctcctatcaacaaaacctgatgctaaaaacagaaaagggagagatgtaggagatcagtcagggtgatgggaaaaactgtaggaagatgcaaaccttcttggaaggctgtaaggtttttacaaaagcttcggaaaaagatttggctgaaggcagccagattctcttatccggtgcctgacagtttaggttgataaaaagggaatgtaaagaaactgatctagataagtttacttagaccttggaacctggcctttaatcatccacgtgcaggactactggggtgggagggtgggaagggggggagcgcaaccatgtgaactgcccaccagtgtgttgactcaaggcctttgtcattaaatctatactgaataaatgccggcagcgcaggcttgtcagggccgcagctgctgactctttacagcaccctccttggtgtctgtgggtggcctggtcccctagcccgctctttcactggtttctggtgtctgagtgcacttgttcatccatcattcagccagggtctgcgggttggacccagca

SEQ ID NO: 395 - DNA, 429 bp, Homo sapiens
gtcaggcctctgagcccaagctaagccatcgtatcccctgtgacctgcacgtatatgtccacatggcctgaagcaagtaaagaatcacaaaagaagtgaaaatggccggttcctgccttcactgatgacattccaccactgtgatttgttcctgccccaccttaactgagcaattaaccttgttaaattccttctcctggctcagaagctcccccactgagcaccttgtgacccgcccctgcccgtaagagaaaaaccccctttgattgtaattttccactacccacccaaatcctataaaacagccccaccctaggtcccttcgctgactctcttttcggactcagcccacctgcacccaggtgaaataaacagccttgttgctcacacaaagcctgtttggtggtctcttcacatggacgcgcgtga

SEQ ID NO: 396 - DNA, 4757 bp, Homo sapiens
gtcaggcctctgagcccaagcctgcacatatacatccagatggcctgaagcaactgaagaatcacaaaagaagtgaaaatggccgattcctgccttaactgatgacattaccttgtgaaattccttctcctggctcagaagctcccccactgagcaccttgtgaccactacccctgcctgccagagaacaactccctttgattgtaattttccactacctacccaaatcctataaaactgccccatccctatctccctttgctgactttcttttcagactcagcccgcctgcacccaggtgattaaaaagctttattgctcacacaaagcctgtttggtggtctcttcccacggatgcacgtgacatttggtgccataactcagatcaggggacttcccttgggagatcaatcccctgtcctcctgttctttgctccgtgagaaagatccacctatgacctctggtcctcagaccaaccagcccaaggaacatctcaccaattttaaatctggtaagcagcctctttttgctctcttctccaacttctttcactatccctcaacctctttctcctttcaatttctgtgctacccttcaatctctcccttcccttaatttcagtgcctttccttttctggtagagacagaggagacatgttttatgtgtgaacccaaaactctgacgatggtcatggtctcgggaagacagtcttccctcagtgtttaatcactgcggggatgcctgcctgattattcacccacatttcagaggtgtctgatcaccatggggatgcctgccttgatccttcaccttggtggcaagcaccacctccccgggaggcaagtaccccccaccccttctctccgtgtctctaccctctcttttctcagggcttgcctccttcactataggcaaacttccaccctccattcctccatcttcacccttagactgtgttctcaataacttaaaacctcttcaactcacacctgacctaaaacctaaacatcttattttcttctgcaataccacttgaccccaatacaaacttgacaatggttccaaatagccagaaaacagcactttcgatttctccatcctacaagatctagataattcttgtcgtaaaatgggcaaatggtctgaggtgcctgatatccaggaattcttttgcacatcagtccctatcgggggacctgccctgataatcacgtaggttcttttctatttccctaagcattgactggcttgagaaataaaaggacagagtacaaaagagataaattttaaagctgggcatctgggggagacatcacacatcggtaggatctgtgatgccccacaagccacaaaaaccagcaagtttttattagggattttcagaaggggagggagtgtgcgaataggtgtgggtgacagacatcaagtacttaacagggtaatagaatatcacaaggcaagtggaggcagggtgagatcacaggaccacaggaccaaggtgaaattaaaattgctaacgaagtttagggcaccactgtcattgataatatcttatcaggagacagggttttgagatcaaccggtctgaccaaaatttattaggtgggaatttcctttttctaataagcctgggagcgctatgggagactggagtttatttcacccctgcagtctcaaccataagagacaggtacgccccaggggggccagttcagagacctacccctaggtgcgcattctctttctcagggatatcccatgctgagaaaaagaattcagcgatatttctcccatttgcttttgaaagaagagaagtatggctctgttctgcccagctcaccggcagtcagagtttaaggttatctgtcttattccctgaacaattgctgttatcctgttcatttttcagggtgcccacatttcatattgctcaaacacacatgctgtacaatttgtgtagttaatgcaattattacagggtcctgagacaatatacatcctcctcaactgacaagattgagattaaattaaagacaggcataggaaatcacaagggtattgattggggaagtgataagtgtccatgaaatctttacaatttatgtttagagattgcaataaagacaggcataagaaattacaaaagtattaatttggggaactaataaatgtccataaaatcttcacaatccacattcttctgccatggcttcagccggtccctccatttggggtccctgacttcctgcaacaagtcttttcctaatctctgctcccaatgtgactcatcccaaatctttcttctttctctcctgtctcttccttcagtctccaccccaagctctgagtcctttgaatcctccttttctacagacccatctgacctctcccctcctccccaggctgctcctcaccaggctgagccaggtcccaatttttcctcagcctctgctctcccaccctataatccttctatcacctcccctcctcacacctggtccagcttacagttgcgttctgtggctagccctcccccatctacccaacagtttcctcttacagaggtggctgaagctgaaggcatagtcaaggttaatgctcctttttctttagctgacctctcccaaatcagttagtgtttaggctctttttcatcatatataaaaacccagcccagttcatggcccatttggcaacaacccttagacactttaccaccctagctagacccagaagggtcagaaggccgtctcattctcaatatgcattttatcacccagtcagctcctgacattagaaaaagctccaaaaattagactccagccctcaaaccccacaacaggaattaatcaacctcacctgcaaggtgtacaataatagagaagagttgcaattacttgcctccactgtgagagaaaccccagccacatctccagcacacaagaacttcatagcacctaagccacagcagtcaggcattccttccagacctcctcccccaggatcttgcttcacacgctggaaatctggccactgggccaaggaatgctgcagcctgggattcctcgtaagccatgtcccatctatgcaggaccccactggaaataggattgtccaactcacctggcagctactcctacagcccctaaagctctggtccaaggctctctgactgacactttcccagatctgcttggcttagcagctggagactgacgctgcctgatcacctcagaagcctcctggaccatcacagacactttaggtaactcttacagtggaaggtaagtccatccccttcttaatcaatatggaggctacccactccacattaccttcctttcaagggcctgtttcccttgcccccataacggttgtgggtattgacggccaagcttcaaaaccccttaaaactctcccactctggtgccaacttggacaacattcttttatgcactctttttcagttattcccacctgcccagttctcttattaggccaagacattttaaccaaattatctacttccctggctattcctggactacagccacacctcattgccgccttttccccagttcaaagcctccttcgcatcctccccttgtatctccccaccttaatccacaagtataggacacctttactccctccttggggaccgatcatgcaccccttagcatcccattaaaacacaatcacccttaccccgctcaatgccaatatcccatcccacaacatgctttaaaaaggttaaagcctgttatcactcgcctgctgcagcatgagcttctgaagcctataaactctccttacaattctcccattttacctgtccaaaaaccggacaagtcttacaggttagttcaggatctgcaccttatcaaccaaattgtttgcctatccaccccatggtgccaaacccatatactctcttattcttaatacctcccttcacaacccctccacaacccattattatgttctggatctcaaatatgctttctttactattcctttgcacccttcctccaaggccctctttacttttacctggactgaccctgacacccatcagtctcagcaacttacctgggctgtactgctgcaaggcttcagggacagctcctattacttcagtcaggccctttctcatgatttactctctttccatccatctacatctcaccttattaaatattttgatgaccttctactttatagcccctcctacaaatcttcccaacaggacaccctcctgctgctccaacaatctattctcaaaaggacattgcacatctgcctccaaagcccaaatttcttcctcatccgttatatatcttgacataattcttcataaaaacacacatgctctccctgctgatcgtgtctggctaatctcccaaaccccaacccccttgacaaagcaacaactcctttctttcctgagcatggttcagtacttttgcctttaaatacctagctttactgtcctgactaaaccattatataaactcacaaaagaaaacctagctgaccccatagatcctaaatcctttccccactcctttttccatttcttaaaacagccctggaagctgctcccacactagctctccctaactcatctgaaccctttttcattacacacagctgaagtgcagggctgtgcggtcagaattcttacacaagagccaggaccatgacctgtagcctttctgtccaagcaacttgatcttactgttttaggctggc

SEQ ID NO: 397 - DNA, 5540 bp, Homo sapiens
gtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagacgtgtaaatggccggtccttgccttaactgatgacattaccttgtgaaagtccttttcctggctcatcctggctcaaaaagcacccccactgagcaccttgcgacccctactcctgcccgccagaaaacaaaccccctttgactgtaattttcctttacctacccaaatcctataaaacagccccacccttatctcccttcgctgactcttttttcagactcagcccgcctgcacccaggtgaaataaacagccatgttgctcacacaaagcctgtttggtggtctcttcacaccgacgcgcatgaaatttggtgccgtgactcggatcggggacctcccttgggagatcaatcccctgtactcctgtgttctttgctccgtgagaaagatccacctacgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccatggacccaaaactccggcgccggtcacggactgggaaggcagccttcccttggtgtttaatcattgcagggacgcctctctgattatacacccacgtttcaagggtgtcagaccatgcagggacgcctgccttggtccttcacctttagcggcaagtcctgcttttctggggaaggggcaagtacctcaaccccttctctccttgtctctaccccttctctgcttttctgggagaggggcaagtacccctcaaccccttctccttcacccttagcggcaagttccgcttttctatggggcaagaaccctcaatctcttatttccactccccaacctcttatctctgtgccccaatcccttatttccatgccccgacctcttatctctgcaccccaaccccttttcccacttttctggaaggtaagaacccccgaactccttccctccatttctctactctctcttttctctaggcttgtttccttcactatgggcaaccttccaccctccattcctccttctactcccttggcctgtgttctcaaaaacttaaaacctcttcaactcacacctgacctaaaacctaaatgccttattttcttcggcaatgccacttgaccccaatacaaactcgacagtagttccaaatagccagaaaatggcactttgaatttttccatcctgcaaaatctaaataattattgtcgtaaaataggcaaatggtctgaggtgcctgacgtccaggcattattttacacatcagtcccttcctagtctctgtgcccagtgcaactcgtctcaaatcttctttctttccctcccgcctgtcccctcagtaccaaccccaagcgtcgctgagtctttctaatcttccttttctacagacccatctgacctctcccctcctcgccagcccaagctaggtcccaattcttcctcagcctccgctcctgcaccctgtaatctttttatcgcctcccctcctcacacctggtccggcttacagtttcgttccgtgactagccctcctccacctgcccagcaatttactcttaaaaaggtggctggagccaaaggcatagtcaaggttaatgctcctttttctttatcccaaatcagaagcgtttaggctctttttcatcaaatataaaaacccggcccagttcatggctcgtttggcagcaaccctgagacgctttacagccctagaccctaaaaggtcaaaacgccatcttattctcaatatacattttattacccaatctgctcccgacattaaataaaactccaaaaattggaatctggccctcaaaccccacaacaggacttaattaacctcgccttcaaggtgtacaataacagaaaaaagttgcaattccttgcctccactgtgagacaaaccccagccacatctccagcacacaagaacttccaaatgcccgaaccgcagcggccaggcgttcctccagaacctcctcccacaggagcttgctacacgtgccagaaatctggccactgggccaaggaatgcccgcagcctggcattcctcctaagccgtgtcccatctgtgtaggaccccatgaaaatcagactgttcaactcacctggcagccactcccagagcccctggaactctggcccaaggctctctgactgactccttcccagatcttctcggcttagcggctgaagactgacactgcccgatcgcctcggaagccccctggaccatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaagctccccaactctggtgccaacttagacaatactcttttaagcactcctttttagttatccccacctgcccagttcccttattaggctgagacactttaactaaattatctgctttcctgactattcctggaccacagctatatctcattgccgcccttcttcccaatccaaagcctcctttgtgtcctcctcttgtatcccccgaccttaacccacaagtataagatacctctactccctccttggtgaccgatcatgcaccccttaccatctcattaaaacctaatcacccttaccccactcaacgccaatatcccatcccgcagcacgctttaaaaagattaaagtctgttatcactcgcctgctacagcatggccttttaaagcctataaactctccttacaattcccccattttacctgtcctaaaaccagacaagccttacaagttagttcaggatctctgccttatcaaccaaattgttttgcctatccaccccgtggtgccaaacccatatactctcctatcctcaatacctgcctctacaacccattattctgttctagatctgaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgcggtcagaattcttacacaagagccaggaccacaccctgtagcctttctgtccaaacaacttgaccttactgttttagcctagctctcatgtttgcgtgcagtggctgctgctgctttaatacttttagaggccctcaaaatcacaaactatgctcaactcactctttacagttctcataacttccaaaatctgttttcttcctcacacctgacgcatatactttctgcttcctggctccttcagctatactcactctttgttgagtctcccacaattaccattgttcctggcccggacttcaatcaatccagcctcccatattattcctgataccacacctgacccccatgactgtatgtctctgatccacctgacattcaccccatttccccaaatttccttctttcctgttcctcacccagatcacacttgatttattgatggcggttccaccaggcctaatcgccacacaccagcaaaggcaggttatgctatagtacaagccactagcccacctcttagaacctctcaacaacatgcccgagtcaggaaactaaaatacctcttaatctaaatagacactttcactgaataagtaaaggcctttcctacagggtctgagaaggccaccgcagtcatttcttcccttctgtcagacataattcctcaatttagccttcccacctcaatatagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaatttaaaaaggactggacaatagttttaccagtttcccttctcagaatacagcccatttaagctcctgtatagacgctcctttttattaggccccagtctcattccagacaccagacgaccaacttagactgtgccccccaccaaaaaaaacttgtcatccctactattttctgtctagtcatactcctattcaccgttctcaactactcatacatgccctgctcttgtttacactgccggtttacactgtttttccaagccatcacagctgatatctcctggtgctatccccaaactgccactcttaactcttgaagtaaataaataatctttgctggcaggactatgccgaatctccttaagcactctctaatcagacatcctgagtcgtcccaattcttagaccttttatacctgtttttctccttctgttattccatttagtttttacaattcatacaaaaccgtatccaggccatcaccaatcattctatacgacaaatgtttcttctaacatccccacaatatcaccccttaccacaagacctgcctccagcttaatctctcccactctaggttcccacaccgcccctaatcccgcttgaagcagccctgagaaacatcgcccattctctctccataccatcccccaaaattttcccaacactttaccattattttgttttatttttcttattaatataagaaggcaggaatgtcaggcctctgagcccaagccaagccatcgcatcccctgtgacttgcacatatatgcccagatggcctgaagtaactgaagaatcacaaaagaagtgaatatgccctgccccgccttaactgatgacattccaccaaaaaagaagtgtaaatggccggtccttgccttaactgatgacattaccttgtgaaagtccttttcctggctcatcctggctcaaaaagcacccccactgggcaccttgcgacccccactcctgcccgccagagaacaaaccccctttgactgtaattttcctttacctacccaaatcctataaaacagccccacccttatctcccttctctgactcttttttcagactcagcccgcctgcacccaggtgaaataaacagccatgttgctcacacaaagcctgtttggtggtctcttcacacggacgcgcatga

SEQ ID NO: 398 - DNA, 5717 bp, Homo sapiens
gtcaggcctctgagcccaagccaagccatcgcatcccctgtgacttgcacgtattcgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttctcctggctcatcctggctcaaaaagcacccctactgagcaccttgcgacccccactcctgcccgccagagaacaaaccccttttgactggaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgtgcatgaaatttggtgccgtgattcagatcgggggacctcccttgggagatcaattccctgtcctcctgttctttgctccatgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcaatctctcccttaatttcaattcctttcattttctgggagagacaaaggagacacattttatccgtggacccaaaactccggcacgggtcatggactgggaaggcagccttcccttggtgtttaatcattgcagggacgccgctctgattatttacccacgtttcaaaggtgtcagaccacgcagggatgcctgccttggtccttcacctttagcggcaagtcctgcctttctgggaaaggggcaagtaccccaaccccttctctccttgtctctaccccttctctgcttttctgggggaggggcaagcaccccaacctcatatctctgcgccccaatcccttatttctgcaccccaatcccttatttctgcgccccgacctcttgtatctctgtgccccggccccttatctccgtgccccggccccttatttctgcgccccatcccttatttccgcaccccgacctcttatctctgtgccccaaccccttttcccacttttctggaaggtaagaacccccaaacccattccctccatttctctactctctcttttctctaggcttgcttccttcactataggcaagcttccaccctccattcctccttctactcccttggcctgtgttctcaaaaacttaaaagctcttcaactcacacctgacctaaaacctaaatgccttattttcttctgccatgccgcttgaccccaatacaaactggacagtagttccaaatagccagaaaatggcactctgaatttttccatcctgccagatctaaataattcttgtcgtaaaataggcaaacggtctgaggtgcctgatgtccagacattcttttacacatcagtcccttcctagtctctgtgcccagtgcaactcgtcccaaatcttccttctttccctcccgcctgtaccctcagtaccaaccccaagcattgctgagtctttctaatcttccttttctacagaccaatctgacctctcccttcctccccaggctgctcctcgccaggctgagctaggtcccaattctacctcagcctctgctcctccaccctataatctttttgtcacctcccctcctcacacctggtccggcttacagtttcgttcagtgactatccctccccatcctgcccaacaatttactcttaaaaaggtggctggagctaaaggcatagtcaaggttaatgctctttttctttatcccaaatcagatagcgtttaggctctttttcatcaaatataaaaatccagcccagttcatggctcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaatagaaaaaagttacaattccttgcctccactgtgagacaaaccccagccacatctccaacacacaagaacttccaaacgcctgaaccgcagcagccaggcgttcctccagaacctcctcccccaggagcttgctacatgtgccggaaatctggccactgggccaaggaatgcccgcaggccgggattcctcctaagctgtgtcccatctgtgtgggaccccactgaaaatcggactgttcaactcacgtggcagccattcccagagcccctggaactctggcccaaggctctctgactccttcccagatcttctcggcttagcggctgaagaccgacactgcccgatcacctcggaagccccctagaccattatggacgccaagctttgggtaactctcacagtggaaggtaggcccgtccccttcttaatcaatatggaggctacccactccacattaccttcttttcaagggcctgtttcccttgcctccataactgttgtgggtattgacagctaggcttctaaacttcttaaaactccccaactctggtgccaacttagacaatactcttttaagcactcctttttagttacccccacctgcccagttcccttattaggctgagacactttaactaaattatctgcttccctgactattcctgggctacagccacacctcattgctgccttttcccccagttcaaagcctccttcacatcctccccttgtatctccccaccttaacccacaagtataagatacctctactccctccttggcgaccgaccatgcaccccttaccatctcattaaaacctaatcacctttaccccactcaacgccaatatcccatcccgcagcacgctttaaaaagattaaagcctgttatcactcgcctgctacagcatgtccttttaaagcctataaactctccttacaattcccccattttacctgtcctaaaaccagacaagccttacaagttagttcaggatctgcaccttatcaaccaaattgttttgcctgtccaccccgtggtgccaaacccatatactctcctatcctcaatacctgcctctacaacccactattctgttctagatctcaaacatgctttctttactattcctttgcacccttaatcccagcctctcttcactttcacttggactgaccctgacacccatcaagcttagcaaattacctaggctgtactgccgcaaagcttcacagacagcccccgttacttcaatcaagcccaaatttcttcctcatctgttacctatctcggcataattctcataaaaacacacgtgctctccctgcaatcgtgtccgactgatctctcaaacccaagcaccttctacaaaacaacaactcctttccttcctaggcatggttagcgcggtcagaattcttacacaagagccaggaccacaccctgtagcctttatgtccaaacaacttgaccttactgttttagcctagccatcatgtctgggtgcagcggctgccgctgctttaatacttttagaggccctcaaaatcacaaactatgctcaactcactctctacagttctcataacttccaaaatctattttcttcctcatacctgacgcatatactttctgctccccggctccttcagctgtactcactctttgttgagtctcccacaattaccgttgttgctggcccagacttcaatccggcctcccacattattcctgataccacacctgacccccatgactgtatctctctgatccacctgacattcaccccatttccccaaatttccttctttcctgttcctcaccctgatcatgcttgatttattgatggcggttccaccaggcctaatcaccacacaccagcaaaggcaggttatactatagtacaagccactagcccgcctcttagaacctctcatttcctttccatcgtggaaatctatcctcaaggaaataacttctcagtgttccatctgctattccactactcctcagggattattcaggccccctcccttccctacacatcaagctcgaggatttgccccacccaggactggcaaattagctttactaaacatgccctgagtcagataactaaaatacctcttagtctaggtagatactttcactggataggtagaggccttttctacagggtctgagaaggccacggcagtcatttcttccattctgtcagacataattcctcagttaagccttcccacctcaatacagtctgataacagatgagcctttattagtcaaatcagccaagcagtttttcaggctcttagtattcagtgaaacctttatatcccttacggtcctccgtcttcaagaaaagtagaatggactaaaggtcttttaaaaacacacctcaccaagttcagccaccaaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgcccccaaaaacttgtcatccctactatcttgtcaagtcatactcctattcaccgttctcaactactcatacatgccctgctcttgtttacactgtttttccaagccatcacagctgatatctcctggtgctatccccaaactgccactcttaacccttgaagtaaataaataatctttgctggcaggactatgctgaatctccttaggcactctctaatcagatatcctgagtagtcccaattcttagaccttttatacctgtttttctccttctgttattccatttagtttttcaattcatccaaaaccgtatccaggccatcaccaatcattctatacgacaaatgtttcttctaacaaccccacaatatcaccccttaccacaagacctgcctccagcttaatctctcccactctaggttcccacgccgcccctaatcctgcttgaagcagccctgagaaacatcgcccattctctctccataccaccccccaaaaattttcgccgccccaacacttcaacactattttatttttcttattaatataagaaggcaggaatgtcaggcctctgagcccaagccaagccatcgcatcccgtgacttgcacgtatacacccagatggcctgaagtaactgaagaatcaaaagaagtgaatatgccctgccccaccttaactgatgacattccgccacaaaagaagtgtaaatggctggtctttgccttaagtgatgacattaccttgtgaaagtccttctcctggctcatcctggctcaaaaaacacctccattgagcaccttgcgacccccactcctgcccaccagagaacaaaccccctttgactgtaattttcttttacctacccaaatcctgtaaaacggccccacccttatctcccttcgctgactctcttttcagactcagcccgcctgcacccaggtgaaataaacagccatgttgctcacacaaagcctgtttggtggtctcttcacacggatgcacatgaaa

SEQ ID NO: 399 - DNA, 5703 bp, Homo sapiens
gtcaggcctctgagcccaagtcaagccatcacatcccctgtgacttgcacgtatatacccagatggcctgaagtaactgaagaatcacaaaagaagtgaaaatgccctgccccgccttaactgatgacattccaccacaaaagaagtgaaaatggctggtccttgccttaagtgatgacattaccttgtgaaagtcctttccctggctcatcctggctcaaaaagctcccccactgagcaccttgcaaccccccactcctacccacccgagaacaaatcccctttgactgtaattttcctttatctacccaaatcctataaaacatccccactcttatctcccttcactgactctcttttcagactcagcccacctgcacccaggtgattaaaagctttattgctcacacaaagcctgtttggtggtctcttcacacagatgcaagtgaaatttggtgccatgactaggatcgggggacctcccttggcagatcaatcccctgtcctcctgctctttgctccatgaaaaagatccacctacaagctcgggtcctcagacccaccagcccaaggaacatctcaccaattttaaatagggtaagtggcctattcttactgtcttctccaacctctctcactatccctcaaccactttctcctttcaatcttggcaccacccttcaatctctcccttctcttaatttcaattcctttcattttctggtagagacaaaggagacaggttttatctgtggacccaaaactccagcgccggtcatggactcaggaaggcagccttctcttggtgtttaatcattgcagggatacctctctgattattcatctacgtttcagaggtgtctgaccatacagggatgcctgccttggtccttcacccttagcggcaagtcccgcttttctggggggaggggcaaaaaccctgaccccttctctccctgtctctaccccttctctgcttttctggagggaaagaaccccccagccccttatttctgtgccccaacctcttatctctgtgccccaaccccttatttccactcctcaacacctttcccacttttctggagggtaagaacccccaaaccccttctctctgtgtctctactctctctctgggcttgcctccttcactatgggcaagcttccaccctccactcctccatcttctcccttagcctgtgttctcaagaacttaaaacctcttcaactcacactgacctaaaacctaaatgccttattttcttctacaatgccacttgaccccaatacaaactagacagtggttccaaatagccaaaaagttgcattttcgatttttccatcctacaagatctagataattctcatcataaaatgggcaaacggtctgaggtgcctgacatccaggcattcttttacacattgttcccttcctagtctctgttcccaatgcgactcgtcccaaatcctccttccttccctcccgcctatcccctcagtctcaaccccaagcgtcgctgagtctttctaatcttctttttctacagacccatctgacctctcccctccttgccaggctgagccaggtctcaattattcctcagcctcggctcccccaccctataatcctgttatcacctcccctcctcacacctggtccagcttacagtttcattccttgactagctttcccccacctgcccagaaatttcctcttaaaaaggtggctggagctaaaggcatagtcaaggttaattctcctttttctttatccaacctctcccaaaatcagttagtgtttaggctcttttcatcaaatatgaaaaacccagcccagttcatggctcatttggcagcaaccctgagacgctttacagccctagaccctgaaaggtcagaaggccgtcttattctcaatatgcattttattttattacctaatctgttcccgacatgaaataaagctccaaaaattaaattccggccctcaaaccccacaacaggacttaattaacctcaccttcaaggtgtacaataatagaggcagccaagtagcaatgtatttctgagttgcaattccttgcctccactgtgagagaaaccccagctacatctccagcacacaagaactccaaacacctgaaccgcagctgccaggggttcctccagaacctcctccccctggagcttgctacaagtgccagaaatctggccactgggccaaggaatgcccacagcccgggatttctcctaagctgtgtcccatctgtgcaggaccccactgaaaatcggactgttcaactcacctggcagccacttccagagcccctggaactctggcccaaggctctctgactgactccttcccagatcttctcggtttagcagctgaagactgacactgcccgatcgcctcagaggcctacagggccatcacagatgctctaggtaactctcaaagtggaaggtaagtccgtccccttgttaaccaatacggaggctacccactccacattaccttcttttcaagggcctgtttcccttgcctccatacctattgtgggtattgacggccaggcttctaaacctcttaaaactccccaactctggtgccaacttaggcaataccttttaagcacttctttttagttatccccacctgccctgttcccctatcaggccgagacactttaactaaattatctgcttctctgactattcctggggtacagcctcacctcattgccaccttttcccccagttcaaagccttcttcacatcctccccttgtatctccccaccttagcccacaagtataagatacctctactccctccttggcgaccgatcatgcacccctttccatctcattaaaagctaatcacccttaccctgctcaatgctaatatcccatcccacagcacgctttaaaaggattaaattctgttatcactcacctgttatagtatggccttttaaaggctataaactctccttacaattccccccaatttacctgtcctaaaaccagaaaagacttacaggttagttcagtatctgcgccttatcaaccaaattgttttcagcctttctgtccaaacagcttgaccttactgttttagcctagccctcatgtctgcgtgcagcagctgctgctgctttaatacttttgggggccctaaaaatcacgaactatgctcaactcactctctacatttctcataacttccaaaatctattttcttcctcatatctgacacatatactttctgctcccccacttcttcagctatactcactctttattaagtctcccacaattaccattgttcctggcacggacttcaatctggcctcccacattattctggataccacacctgacactcatgactttatctctctgatccacctgacactcaccccatttccccatatttccttctttcctgttcctcaccctgatcacatttagtttattgatggcagttccaccaggcctaatcgccactcaccagcaaaggcaggctatgctatagtatcttccacatctatcattgaggctaccactctgcccccagccccactacctctcagcaagccgaactagttgccttaattcaagccctcactcttgcaaaaggattacgtgtcaatatttatagtgactctaaatacgcctttcatattctgcgccagcatgctgttatataggctgaaagaggtttcctcactatgcaagggtcctccatcattaatgcctttttaataaaagctctgctcaaggccgctttacttccaaaggaagatggagtcattcactgcaaaggccatcaaaaggcatcagatcccattgctctagacaatgcttatgctgataaggtggctagacaagcagctagctttccaacttgtgtccctcacaccagtttttctccttcacatcggtcactcccacctactcccctgctgaaacttccacctatcaatctcttcccacacaaggcaaatggttcttagaccaaggaaaatatctccttccagcctcacaggcccattctattctgtcgtcatttcataacctcttccatgtaggttaaaagctgctagcccctctcttagaacctctcatttcctttccatcatggaaacctatcctcaaggagaccacttctcagtgttccatctgctattctactacccctcagggattgttcaggccccctcccttccctacacatcaaactcggggatttgcccctgcccaggactggcaaattgactttactcacatgccccaaaactaaaatatctgttcgtctgggtagacactttcactggatgggtagaggcctttcccacagagtctgagaaggccaccgcagtcatttcttcccttctgtcagacacaattcctcggtttggccttcccacctctatacaatctgataacggaccagcctttactagtcaaatcacccaagcagtttctcaggctcttggtattcagtggaaccttcatatcccttaccgtcctcaatcttcaggaaaggtagaatggactaatggtcttttaaagacacacctcaccaagctcagcctccaacttaaaaaggattggacagtacttttacctcttgcccttttcagaattagatcctatcctcgagatgctacagggtacagtccatttgaacttttatatggacgccctttcttggttggccccaacctcatcccagacaccagccctctaggcgactatcttccagtcctccaacaggctagacaggaaattcgccaggctgctaatcttctctttcctactccagatccccagccacatgaagacaccctagctggacgatcagttcttgttaagaatctgacccctcaaactctacaacctcgatggactggaccctacttagttatctgtagtaccccaactgctgtctgcctgcaggatcctccccactgggttcaccattccagaataaagctgtgtccattggacagccagcctaatctctcctcttcctcctggaagtctcaagtactctcccctacttcccttaaactcactcatattcatgaaaaacagtaataacccttatgagcctaacacattccttcattctattaggtctgttcgtccttaccctactttttgtaacagggctttacgaagtcacccccaccacttaggccgagccccaaaaagctagtcatccctgctatcttctgtctggtcatactcctattctccattctcaactacttataaatgctttactcttgtttactctgcccagatggcctgaagtaactgaagaatcacaaaagaagtgaaaatgccctgccccgccttaactgatgacattccaccacaaaagaagtgaaaacagccggtccttgccttaagtgatgacattaccttgtgaaagtccttttcctggcttatcctggctcaaaatgctcccccactgagcaccttgtgacccccactcctgcccaccagagaacaaatcccctttgactgtaattttcctttatctacccaaatcctataaaacagccccacccttatctccctttgctgactctcttttcagactcagtctgcctgaacccaggtgattaaaaggtttattgctcacacaaagcctgtttggtagtctcttcacagggacgcaagtgaaa

SEQ ID NO: 400 - DNA, 2695 bp, Homo sapiens
gctggtcagaattgttacacaagagccaggaccacaccctgtagcctttttgtccaaacaacttgaccttactgttttaggctggccatcatgtctccgtgcagcagctgctgcagccctaatacttttagaggcccttaaaatcacaaactatgctcaactcactctctacaattctcataacttccaaaatctattttcttcctcacacctgacacatatagtttctgctcctggctccttcagctgtactcactctttgttgagtctcccacagttaccattgttcctggcccggacttcaatctggcctcccacattattctggataccacacctgaccctcatgactgtatctctctgatccacctgacattcaccccatttccccttatttccttctttcctgttcctcaccctgatcacatgtagtttattgatggcagttccgccaggcctaatcgccacacaccagcaaaggcaggctatgctatagtatcttccacatctattgttgaggctaccgctctgccctcctccactacctctcagcaagccgaactagttgccttaactcaagccctcactcttgcaaaaggactacgtgtcaatatttatagtgactctaaatatgcctttcatattctgcaccaccatgctgttatataggctgaaagaggtttcctcactatgtaagggtcctgcatcattaatgctctttaataaaaactctgctcaaggctgctttacttccaaaggaagctggagtcattcactgcaaaggccatcaaaaagcatcagatcccattgctctagacaacgcttatgctgataaggtggctagacaagcagctagctttccaacttctgtccctcatgcgtttttctccttcacatcggtcactcccacctactcccctgctgaaacttccacctaccaatctcttcccacacaaggcaaatagttcttagaccaaggaaaatatctccttccagcctcacaggcccattctattctgtcgtcatttcataacctcttccacgtaggttacaagccgctagcccatctcttagaacctctcatttcctttccatcatggaaatctatcctcaaggagatcacttctcagtgttccatctgctattctactacccctcatggattgttcaggcctcctccctttctacacatcaagctcgaggatttgtccctgcccaggactggcaaattgactttactcacatgccccaagtcggaaaactaaaatatctcttagtctaagtagacactttcactggatgggtagaggcctttcccacaaggtctgagaaggccaccgtggtcatttcgtcccttctgtcagacataattccttggtttcgccttcccacctctatatagtctgataacggaccagcctttattagtcaaatcagccaagcattttttcaggctcttagtattcagtgaaacctttatatcccttacagtcctcagtcttcaggaaaagtagaacagactaatggtcttttaaaaacacacctcaccaaactcagccaccaacttaaagaggactagacaatacttttaccactttcccgtctcagaattcaggcctgtcctcggaatgctacaaggtatagcccatttgagctcccgtatagacgctgctttttattaggctccagtctcattccagacaccagaccaacttggactgtgccccaaaaaacttgtcatccctactatattctgtctagtcatactcctattcaccgttctcaactactcatacatgccctgctcttgtttacactgccagtttacactgtttctccaagtcatcacagctgatatctcctggtgctatcccaaaccgccactcttaactcttaaatcaataatctttgctggcaaggctatgctgaacctccttaggcactctctaattagatgtcctaggtcctcccaattcttagtcctttaatacctgtttttctccttctcttattttgtttagtttttcaattcatacaaaactgtatccaggccatcaccaataattctaaatgagaaatgcttcttctaacgaccccacaatatcaccccttaccacagaatcttccttcagcttaatctgtcccactctaggttcccacgccgcccctaatcccgcttgaagcagccctgagaaacatcgcccattctctctccataccacccccaaaaattttcaccgccccaatgctttaccactatttcattttatttttcttattaatataagaggacaggaatgtcaggcctctgggcccaagctaagccatcatatcccctgtgacctgcacatacacatccagatggctggttcttgccttaactgatgacattccaccacaaaagaagtgaaaatggcctgttcctgccttaactgatgacattatcttgtgaaatttcttctcctggctcattctggctcaaaagctcccctactgaacacttgtgacccccacttctgcccatcagaccacaaccccactttttcctttacctacccaaatcctataaaacggccccacccctatctcccttcgctctctttttggactcagccagcctgcacccaggtgattaaaagctttattgctcacacaaagcctgtttggtggtctcttcacatggacgcacatgaaa

SEQ ID NO: 401 - DNA, 6025 bp, Homo sapiens
gtcaggcctctgagcccaagctaaaccatcatatcccctgtgacctgcacgtatatatccagatggcctgaagtaattgaagaatcacaaaagaagtgaaaatggcctgttcctgccttaactgatgacattaccttgtgaaattccttctcctggctcatcctggctcaaaagctcccccactgagcaccttgtgtcccccgcccctgcccaccaaggaacacccccctttgactgtaattgtccactacctacccaaatcctataaaatggccccacccctatctcctttcgttgactcttttttcagactcagccggcctgcaaccaggtgattaaaaagctttattgctcacacaaagcctgttgggtggtctcttcacatggacgtgcgtgaaatttggtgccatgactcggatcgggggaccacccttggaagatcaatcccctgtcctcctgctctttgcttcatgataaagatccacctaatgacctcgggtcctcagaccaaccagcctgaggaacatctcaccaattttaaatcaggtaagcggcctctttttactctcttctccaacctctctcactatccctcaacctctttctcctttcaatcttggtgccatctttcaatctctcccttctcttaatttcggttcctttccttttctggtagagacaggaaatgcattttatctgtgaacccaaaactccggcgccgatcacggactcaggaagacagtcttcccttggtgtttaatcactgcggggacgcctgcttgattattcacccacgtttcagagttgtctgatcaccgcgaggatgcctgccttgatctttcacccttagtggcaaacaccactttttggggggcaagtaccccccaccccttctctccatgtttctaccctctcttttctctccacgttcctgggggacaagcacccccgactccttctctctgtgtctctaccctctcttttctctccactttcctggggggcaaagcaccccccaccccttctctccgtgtctctaccctctcttttctctgggcttgcctccttcactgtgggcaacattccaccctccattcctccttcttctctcttagcctgtgttctcaagaacttaaaacctcttcaactcacacctgacctaaaacctaaatgccttattttctttgcaatgccgcttaaccccaatacaaactcaacaatggttccaaatagccagaaaacggcactttcgatttttccatcctacaagatctagataattcttgttgtaaaatgggcaaacagtctgaggtgcctgatgtccaggcattcttttacacatcggtccctccctagtctctgttcccaatgcgactcatcccaaatcctccttctttccctcccgcctgtcccctcagtcccaaccccaagcgtcgctgcgtcttttcaatcttccaatcttccttttctaccgacccatctgacctctcacctaatccccagaatgctcctcaggtcactccccaccaggctgaatcagactccaattctttctcagcttctgctcctccaccctataatccttctatcacctcctctccccacacccagtccggcttacagttttgttctgcgactagccctccccaacctgcccaacaatttcctcttaaagaggtggctggagctaaaggcatagtcaaggttaacgctccttttcctttatccgacctctgccaaatcagttagtatttaggctctttttcatcaaatataaaaacccagcccagttcatggctcgttgggcagcaaccctgagacgctttacagccctagaccctaaaaggtcaaaaggcagtcttattctcaatatacattttattacccaatccactcccaacattaaataaaactccaaaaattaaattccggccctcaaaccccataacaggacttaattaacctcgccttcaaggtgtacaataatagagtaaaggcagccaagtagcaatgtatttctgagttgtagttccttgcctccactgtgagagaaaccccagccacatctccagtacacaagaacttcaaaatgcctaagctgcagcagtcaagcattcctacaggaccttctccatcaggatcttgcttcaagtgccagaaatctggccactgggccaaggaatgcccacagcccaggattcttcctaagccttgtcccatctgtgtggaaccccactggaaatcggactgtccaactcacctggcagccactcccagagcccctggaactctggcccaaggctgcctgactgactccttcccaaatcttctcggcttagcagctgaagactgacactgcccaatcgccttggaagcttcctggaccatcacagatgctttgggtaactcttacagtggagggtaagtccgtccccttcttaatcaatacggaggctaccaactccacattaccttcttttcaaaggcctgtttcctttgcctccataactgttgtgggtattgatggccaggcttctaaacctctcaaaactccccaactctgaggccaacttggacaatactcttttatgcactccttttcagttatccccacctgcgcagttcccttattaggccgagacactttaaattatctgcttccctgactattcctaggctacagccacacctcattgccaccttttcccccagttcaaagcctccttcacatcctccccttgtatctccccaccttaatcctcaagtataggacacctctattccctccttggcgactgatcatgcaccccttaccatcccattaaaacctaatcacccttaccgtgctcaatgtcaatatcccatcccccagcaggctttaaaaggattaaagcctgttatcactcgcctgttacagcatggccttttaaagcctataaactctccttacaattcccccattttacctgttcaaaaaccagacaagtcttacaattagttcaggatctgtgccttgtcagccaaattgttttgcctatccaccccgtggtgccaaactcatatactctcctcctcaatacctccctccacaacccctccacaacccatcattctcttctggatttcaaacatgctttctttactattcatttgcacccttcatctcagcctctcttcgctttcacttggactgtccctgacacccatcaggctcagcaaactacctaggctgtactgccgcaaggcttcacggacagcccccattacttcagtcaagcccaaatttcttcctcatccattacctatcttggcatagttctcatgaaaacacacgtgctctccctgctgatcatgtccggctaatctcccgaaccccaatcccttctacaaagcaacaactcctttcctttcaagggatggttaggtacttccacctttggatacctagttttaccatcctgactaaaccattatataaactcacaaaagcaaacctagctgaccccacagatcctaaatccttttgccactcctttccattccttaaaaacagccgtagaagctgctctcacactaggtctccctaattcatcccaaccctttttcatcacacacagccaaagtgcagggctgtgcggttggaattcttacacaagagctgggaccacgccctgtagcctttctgtccgaacaacttgaccttactgttttggcctagccctcatgtctgcgtgcagcggctgccgctgctttaatactttcagaggccctcaaaatcacaaactatgctcaactcactctctacagttctcataacttccaaaatctattttcttcctcacacctgacgcatatactttctgcccccctccactacctctcagaaagcttaactcattgccttaactcgagccctcagtcttgcaaaaggactatgtgtcaatatttatactgactctaaatatgccttccatatcctgtacctccatgctgttatatgggcaaaaagctttcctcattacacaagggtcctccatcattaattcctctttaataaaaactcttctcaaggccgctttacttccaaaggaagctggagtcattcactgcaagggccatcaaaaggcatcagatcccatcgctcagggcaacacttatgctgataaggtagctaaaaaagcagctagcattccaacttctgtccctcatggccagtttttctccttctcatcagtcactcctacctactcccccaatgaaacttacacctatgaatctcttcccacacaaggcaaatggttctcagaccaaggaaaatatctccttctagcctcacaggcccattctattctttcgtcatttcataacctcttccatgtaggttacaagccgctagcctgcctcttagaacctctcatttcctttccattgtggaaatctatcctcaaggaaatcacttctcagtgttccatctgctattctactactcctcagggattgttcaggccccctcccttccctacacatcaagcctggggatttgcctctgcccaggactggcaaattgactttactcacatgccccgagtcaggaaactaaaatacgtcttggtctgggtagatactttcactggatgggtagaggcctttcccacagggtctgagaaggccactgcggtcatttcttcccttctgtcagacataattcctcagtttggccttcccgcctctatatagtccaataacagaccagcctttactggtcaaatcacccaagcagtttctcaggctcctggtattcagtgaaaccttcataccccttaccatcctcaatcttcagaaaaggtagaacggactaatggtcttttaaaaacacacctcaccaagctcagccaccaacttaaaaaggactgacaatacttttaccacttgcccttctcagaatttgggcctgtcctcggaatgctgcagggtacagcccattcaagctcctgtatagatgctcctttttattaggccccagtctcattccagacaccagaccaacttggactgtgccccagaaaacttgtcatccctactatcttctgactagtcatactcctattcaccatactcaactactcatacatgccctgctcttgtttacactgccggtttacactgtttctccaaaccattacagctgatatctcctggtgctatccccaaactgccagtcttaactccctcttaaagtaaataaataatctttgctggcagggctatgctgaacctccttgggcactctctaattggatgtcctgggtcctcccaattcttagtcctttaatacctgtttttctccttctcttattccatttagtttttcaattcatacaaaaccgtatccaggccatcaccaataatcctatacaacaaatgtttcttctaacaaccccacaatatcatcccttaccacagaatctgccttcagcttaatctctcccactctaggttcccacgccaccccaatcccgctcgaagcagcccttcaaggctatggagaagcagtatctctccataccaccccccgccaaaatgtttgctgccccaacacttcaacactattttatgttatttttcttattaataaaagaagacaggaatgtcaggcctctgagcccaagctaagccatgatatcccctgtgacctgcacgtatacatccagatggcctgaagtaactgaagagtgaaaatggcctgtgcctgccttaactgatgacattatcttgtgaaattccttctcctggctcatcctggctcaaaagctcccccactgagcaccttgtgtccccccaccgccagagaacaaccccctttgactgtaattttccactacctacccaaatcctgtaaaacggtcccaccccatttcccttcgctgactcttttttcggactcagctggcctgcacccaagtgattaaaaagctttattgttcaaagcctgtttggtggtctcttcacatggacgtgcgtgaaa

SEQ ID NO: 402 - DNA, 963 bp, Homo sapiens
gtggggaaaagcaagagagatcagattgtcactgtgtctgtgtagaaagaagtagacatgggagactccattttgttatgtactaagaaaaactcttctgccttgagattccgtgaccttacccccaaccccgtgctctctgaaacatgtgctgtgtcaaactcagggttaaatggattaagggcggtgcaagatatgctttgttaaacagatgcttgaaggcagcacgctccttaagagtcatcaccactccctaatctcaagtacccagggacacaaaaactgcggaaggccacagggacctctgcctaggaaagccaggtattgtccaaggtttctccccatatgatagtctgaaatatggcgtcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcagtataaaacccgattgtacattccatctactgagatagggaaaaaccgccttagggctggaggtgggacatgccggcagcgatactgctttgtaaagcattgagatgtttatgtgtatgcatatctaaaagcacagcacttaatcctttaccttgtctatgatgcaaagacctttgttcacatgtttgtctgctgacccactccccactatagtcttgagaccctgacacatccccctctcggagaaacacccacgaatgatcaataaatactaagggaactcagaggctggagggatcctccatatgctgaacgctggttccccgggtccccttatttctttctctatactttgtctctgtgtctttttcttttccaagtctctcgttccaccttgcgagaaacacccacaggtgtggggggggggtaacccaccccttca

SEQ ID NO: 403 - DNA, 618 bp, Homo sapiens
accgacaagacatgtcaggcaatcctcaggtgataggcagttgttaaactgtctctttaaaataataattggtcacagccaatgccagggaaaggcactctcccaagagataaacacctgaagctggtgatcagtgacttcctgatatgacctcaggagtggagcgagtggtctcacgcatgcacactaagaggcaaaatggtggagttttactggtatatgacctgcctctaagaatactccaccggtaaaggaaaaacgcctcaagtgagcatgcatagaacttcagtaaacacactgtgcacatggcccctccaaagtgctggcagaccactcagcatgcggacagcctaccccaagggaagaatcgggcaagaagagacacagacaccagaagaatgccaacatataaaagcccaagtcaaaggtctaactgcacactcaagtcacccacttggtcctcttccaagtgtactttacctccttttgttcctgctctaaaactttttaataaactttcactcctgctctaaaaatgggctcagcttcttactctgccttttgttcccttggttgaatcatttcttctgaagaggtaagaattgaagttgctgcaga

SEQ ID NO: 404 - DNA, 693 bp, Homo sapiens
ttacagagggtagctagtcagacatgagcagggcaggagagggacaccttcccaccaggaatgtcaggcaaccaacaggtgatgatcaggcagttatgaaactgtctctctaagataataattggtcacagccagtgccaaggaaaggccatctcccaataaacagaaacatctgaaactggtgatcagcagctcctgataagatctcaggagttgggtaagtgggctcatgcatgcacactaagaggaaaagtggtggagtttaactggtattatgaccttctaggacatttgactggtaagggaagaatgcctcaagtaaggatgcatacaatttcagtaaacacactgtgcatgctcccctcccaagtgctagcaggccactgcatgtgtgaacagcccacctcaagggaagaatcaggggagaagaaacacaagatcccagaagcatcccaacatataaaaccccaagaccaaaggtcaaaccatacacttgatctctcaagtcgcccacccgaccctcttccaagtgtactttacttcctttcattcctgctctaaagctttctaataaactttcactcctgctctaaaacttgcctcggtctcttcttctgccttatgaccttcagttgaattctttcttctgaggaggcaagaattgaggttgctgcagaccatacgaatacgcca

SEQ ID NO: 405 - DNA, 780 bp, Homo sapiens
gagagacaggactagctggatttcctaggccgactaagaattcctaagcctagctgggaaggtcaccacatccacctttaaacaccgggcttgcaacttagctcacacctgaccagtcagatagtaaaaagagctcactaaaatgctaattaggcaaaaacaggaaataaagaaatagccaatcatctattgcctgagagcacagagggagataaatgatcaggatataaacccaggcattcaagccagcaatggctaacctcttcgggtcccctccctttgtatgggagctctgttttcactctgttaaatcttgcaactgcactctcttctggtccgtgtttgttacggcttgagctgagcttttgctcgccatccaccactgctgtttgccgccatcatagaccagccactaacttccatccctctggatctggcagggtgtctgctgtgctcctgattcagtgaggcgcccattgctgctcccgatcgggctaaaggcttgccattgttcctgcatggctaagtgcccagattcatcctaatcgagctgaacactagtcactgggttccacggttctcttctgtgacccacagcttctaatagagctataacactcactgcatggcccaatattccattccttggaatccgtgaggcaaagaaacccagatcagagaacacgaggcttgccaccatcttggaagtggcctgtcaccatcttggaagtggcccgccaccatgttgggagctctgggagcaaggaccccccagtaaca

SEQ ID NO: 406 - DNA, 6629 bp, Homo sapiens
gtcaggcctctgagcccaagcctgcacatatacatccagatggcctgaagtaactgaagaatcacaaaagaagtgaaaatggctggttcctgccttaactgatgacattaccttgtgaaattccttctcctggctcagaggctcccccactgagcaccttgtgaccccctcccctgtctgccggagaacaaccccctttgactataattttccactacctacccaaatcttataaaatggccccacccctatctctctttgctgactctctttttggactcatcctcctgcacccaggcgattaaaaagctttattgctcacacaaagcctgtttggtggtctcttcacatggacgcacatgacatttggtgctgtgactcagatcgggggacctccctcgggagatcaatcccctgtcctcctgctatttgctccatgagaaagatccacctacgacatcgaatcctcagaccaaccagcccaaggaacatctcaccaattttaaatcaggtaagcggcttctttttactctcttctccaacctctctcactatccctcaacttctttctcctttcaatttctgtgtcacccttcaatctctcccttcatttcaatccctttccttttctggtagagacagaggagacacgttttatctgtgaacccaaaactccagcgccagtcatggacttgggaagacagtcttcgcttggtgtttaatgactgaggggatgcctgcttgattattcacccacgtttcagaggtgtctgatcactgtggggacgcctgccttgatccttcacccttagtggcaagtatcactttcctgggggggggcaagcaccccccaccccttatctctgtgtctctaccctctctttactctgggcttatctccttcactatgggcaaccttccaccctccattcctccatcctctcccttagcctgtgttctcaagaacttaaaacctcttcaactcacacctgacctaaaacctaaacaccttattttcttctgcaatgctgcttaaccccaacacaaactcgacaatggttccaaatagccagaaaatggcacttttgatttttacatcctacaagatctagataattcttctcataaaatgggcaaatggtctgaggtgcctgacgtccaggcattcttttacacatcagtctcttcctaatctctgctcccagtgcgactcatcccaaacctttcttctttccctcccacctgtccccacagtcccaaccccaagcgttgctttcaatcttccttttctaccgacccatctgacctctcccttcatcccaagattgctcctcctcaggtaactccccgccaggctgagtcaggctccaattcttcctcagcttccgctcctccaccctataatccttctatcacctcctctccccacacccagtctggcttacagttttgttccgcgactagccctcccccacctcccaacaatttccttttaaaaatggtggctagagctaaaggcatagtcaaggttaatgctcctttttctttatccgacctctcccaaatcagttagcatttaggctttttttcgtcaaatatgaaaacccagcccagtgcatggctcatttggcaacaaccctgagacgctttacagccctagaccctgaaaggtcagaaggccgtctcattctaaatatgcattttattacccaatctgctcccaacattaaataaagctccaaaaattagattctggccctcaaaccccacaacaggacttaacctctccttcaaggtgtacaataatagagaagagttgcaattacttgcctcttctctgagagaaagcctagccacatctccagcacacaagaacttcaaaatgcctaaaccacagtggccaggtgttccttcaggacttcatccctcaggatcttgcttcacgtgctggaaatctggccactgggccaaggaatgcctgtggcccgggatccctcctaagctgtatcccatctatgagggactccactggaaatcggactgtccaactcacctggcaaccactcccagagcccctggaactctggcccaagactctctgactgactccttcccagatcttctcagcttagcagctgaagactgaagctgcccgatcacctcagaagcctcctggaccatcaaagatgctttaggtaactcttacagtggagggtaagtccgtccccttcttaatcaatacagaggctacccactccacattaccttcttttcatgggcctgtttcctttgcctccataactgttgtgagtattgatggccaggcttctaaacctcttaaaactccccaactctggtgccaactaggacaacattcttttatgcactcccttttagttatccccacctgcccagttcccttattaggccgagacattttaactaaattatctgcttccctgactattactgggctacagccacacctcattgccactcttttccccagttcaaagcctccttcgcatcctccccttgtatctccccatcttaatccacaggtatgggatgcctctactccctccctggcaaccacacgcccattactatcccattaaaacctaataacccttaccccactcaatgccaatgccaatatccatcccacaggaggctttaaaaggattaaagcctgttatcactcgcctgttacagcatggccttttaaagcctataaactctccctacaattcccccattttacctgtccaaaaactggacaaatcttacaggttagttcaggatctgcaccttatcaactaaattgttttgcctatccaccctgtggtgcctaacacatacactcttttgtcctcaataccttcctccacaactcactattccattcttgatcttaaagatgcttttttcactattcccctgtaccccttgtcccagcctctctttgcttttacctggactaaccctgacacccatcagtcccagcagcttacctggggtgtactaccacaaggcttcagggacagccctcattacttcagccaagctctttctcataatttactttctttccacccctctgcttctcaccttattcaaaatattgatggccttctactttgtagctcctgctttgaatcttctcaacaagacaacctcctgctccttcaacacttattctccaagggatatccagtatccccctccaaagctcaaatttcttctctgttacctacctcggcataattcttcataaaaacacacataccctccctgccaatcatgtctgactgatgtctcaaaccccaaccccttctacaaaacaactcctttccttcctgggcatggttagatacttttgcctttggatatctggttttgccatcttaacaaaaccgttatataaactcacaaaaggaaacctagctgaccctgtagatcctaaatcttttccccactcctcctttcattccttgaagacagctttagagactgctcccacactagctcttcctgactcatcccaaccctcttcattacacacagtggaagtgcagggctatgcagtgggaattcttacacgaggactgggaccgcaccctgtagcctttttgtccaaacatcttgaccttactgttttaggctggccatcatgtctccatgcagcagctgccactgccctaatacttttaaaggccctcaaaatcacaaactatattcaactcattctctacagttctcataacttccaaaatctgttttctttctcacacctgatgcatatactttctgctccccggctccttcagctatattcactctttgttgagtctcccacaattaccattgttcctggcctggacttcaatccagcctcccacattattccggataccacacctgacccccatgactatatctctctgatccacctgacattcacttcacttctccatatttccttctttcctgttcctcaccctgatcacacttggtttattgatggcagttccaccaggcctaattgccactcaccagcaaaggcaggctatgctatagtatcttccacatctatcattgaggctactgctctgcccccctccactacctgtcagcaagccgaactcattgccttaacttgagccctcactcttgcaaagggactatgcatcaatatttatactgactccaaatatgccttccgtatctttcaccaccatgctgttatatgggcagaaagaggtttcctcactacacaagcgtcctccatcattaatgcctctttaataaaaactttacttacaaaggaagctggagtcattcactgcaagggccatcaaaaggtatcagatcccatcactcagggcaatgcttatgctgataaggtagctaaagaagcagctagcattccaacttctgtccctcatggccagtttttctccttctcattgttcactcccacctactctttcactgaaacttccacctatcaatctcttcccacacaaggcaaatggttcttggaccaaaggaaatatctccttccagcctcacaggcccattctattctgttgtcatttcataacctcttccacgtaggttacaagccgctagcctgcctctcagagcctctcatttcctttccatcgtggacacctatcctcaaggaaatcacttctcagtgttctatctgctattctactgctcctcagggattgttcaggccccctcccttccctacacatcaagctcggggatttgcccctgcccaggactggtaacctgactttactcacatgccctgagtcaagaaactaaaatacctcttagtctaggtagacactttcactgaatgggtagaggcctttcccacagggtctgagaaggccaccacggtcatttcttcccttctgtcagaagtaattcctcggtttggccttcctacctctatacagtctgataacaaaccagcctttattagtcaaatcacccaagcagtttctcaggctctcagtattcagtgaaaccttcataccccttaccgttctcaatcttgaggaaaggtaaaacggactaatggtcttttaaaaacacacctcaccaagctcagccttcaacttaaaaaggactgggcaatacttttaccacttgcccttctcagaattcgggcctgtcctcgggatgctacagggtgcaacccatttgaattcctgtacgaacgctcctttttattaggccctggtctcattccagataccaacccaacttggactgcgccccaaaaacttgtcatccctactatcttctgtctagtcatactcctattcactattctcaactactcttaaatgccctgctcttgtttacactgccagtttacactgtttctccaagccatcacagctaatatctcctggtgctatctccaaaccgccactcttaactgcctcttagagtggacagatgatctttgctgacaaggtacactacaatactctcaccctgatgaaatcctattctttacttttatactcactgttattcttgttcctgttcttatgccaccctctacctctccccagctatctccaccgcactatcaatctcactcactctctcctagccatttataatccttctttaacgaacaattgctggctttgcatttctctttcctccaaaatctcggaggcctcgacttactcactgctaaaaaaaaagaggactctgtatgtttttaagtgaaaagtgttgtttttacctaaatcaatctggcctggtgtatgacaacataaaaaaaactcaaggatagagcccagaaactcaccaaccaagcaagtaattacgctgaacccccttgggcactctctaattggatgtcctgggtcctcccaattcttagtcctttaatacctgtttttctctttctcttattcagaccttgtgtctttcatttagtttctcaattcatacaaaaccatatccaggccatcacgcatcattctatatgacaaatgtttcttctaacaaccccacaatatcaccccttaccacaaaatcttccttcagcttaatctctcccactctaggttcccatgccaccccaatcccactcgaagcagccctgagaaacatcatccattatctctccatatcacccccaaaaattttcgctgccccaacactttaccactatttcgttttatttttcttattaatataagaagacaggaatgtcaggcctctgagcccaagcctgcacatatacatccagatggcctaaaggcctaaaagtaactgaagaatcacagaagaagtgaaaatggccggttcctgccttaactgatgacattaccttgtgaaattccttctcctggctcagaggctcccccactgagcaccttgtgacccccacccctgcctgccagagaacaaccccctttgactataattttccactacctacccaaatcctataaaatggccccaccccatctcccttctctgactctctttttggacacagcccgcctgcaactaggtgattaaaaactttattgctcacacaaagcctgtttggtggtctcttcacacagatgcacgtgaaa

SEQ ID NO: 407 - DNA, 5979 bp, Homo sapiens
gtcaggcctctgagcccaagctaagccatcatatcccctgtgacctgcatgtacacatccagatggccggttcctgccttaactgatgacattccaccacaagagaagtgaaaatggcctcttcctgccttaactgatgaaattgtcttgtgaaattccttctcctggctcatcctggctcaaaagctcccctactgagcaccttgtgacccccactctgcccaccagagaacccccctttgactgtaattttcctttatctacccaaatcctataaaatggccccacccttatctccctttgtcaggcctctgagcccaagctaagtcatcatatcccctgtgacctgcacatacacatccagatggccagtgcctgccttaactgatgacattccaccacaaaagaagtgaaaatggcctgttcctgccttaactgatgacattgtcttgtgaaattcctactcctggctcaacctggctcaaaagctccctcactgagtaccttgtgacccccactcctgcctaccagagaacaaccccccttcttcctttacctacccaaatcctataaaatggccccaccccatctcccttcgctgactctcttttcagactcagcccacctgcacccaggtgaaataaacagttttattgctcacacaaagcctgtttggtggtctcttcacacaggcgcacatgaaatttgatgccgtaactcggatcaggggacctcccttgggaacatcaatcccctgtcctcctgctctttgctctgtgagaaagatccacctacgacctcaggtcctcagactgaccagcccaagaaacatctcaccaatttcaaatccggtaagtggcctctttttactctcttctccaacctccctcactatccctcaacctctttctcctttcaatcttggtgccacacttcaatttctcccttcttttaatttcaattcctttcattttctggtagagacaaaggagacacattttatctgtggacccaaaactccggcgccggtcacggactagggaaggcagacttcccttggtgtttaatcattgcaggacacctctctgattattcacccacgtttcagaggtgtcagaccatgcagggatgcctaccttggtcctttacccttagcggcaagtcccgcttttctggggaagaggcaagtaccccaaccccttctctccgtgtctctaccccttctctgcctttctggggggcaagaaacccccaaccccttctccttcacccttagcagcaagtcccgcttttctgggggaggggaaattaccccaaccccttatatctctgcaccccgatcccttatttccatgccccaacctcttatatctctgtgccccgatcccttatttctgcatcccaacctcatatctctgcaccccaatcccttgtttatgcgccctgacttcgtatctctgtgccctgacccctttcccacttttctggagggtaagaacccccgaaccccttccctgcatgtctctactctctcttttctctgggcttgcctccttcactatgggcaaccttccaccttccattcctccttcgtctcccttagcctctgttcttaagaacttaaaacctcttcaactctcacctgacctaaaatctaagcatcttattttcttctgcaatgctgcttgaccccaatacaaatttgacagtagttccaaatagccagaaaatggcgctttcaatttttccatcctgcaagacctaaataattcttgtcataaaacaggcaaacagtctgaggtgcctgacgtccaggcattcttttacacatcggtcccttcctagtctctgtgcccaatgcaactcatcccaaatcttccttctttcccttctgcctgtcccctcagtcccaaccccaagcatcactgagtctttctaatcttccttttctacagacctatctgacctctcccctcctggccaggctgagctaggtcccgattcttcctcagcctctgctcctccaccctataatccttttatcacctcccctcctcacacccggtgcggcttacagtttcgttccatgactagccctcccccacctgctcagcaatttcctcttaaaaaggtgactggagctaaaggcatagtcaaggttaatgctcctttttctttatcccaaatcagatagcgtttaggctctttttcatcaaatataaaaatccagcccagttcatgactcgtttggcagcaaccctgagatgctttacagccctggaccctaaaaggtcaaaaggccatcttattctcaaaatacattttattacccaatctgctactgacattaaataaaactccaaaaattaaattccagccctcaaaccccacaacaggatgtaattaacctcgccttcaaggtgtacaataatagaaaaaagttgcaattccttgcctccactgtgagacaaaccccagccacatctccagcacacaagaacttccaaatgcctgaaccgcagcggccagacattcctccagaacctcctcccccaggagcttgctacaagtgccagaaatctgaccaccaggccaaggaatgcctgcagcccaggattcctcctaagccgtgtagcatctgtgcgggaccccactgaaaatcagactgttcaactcacctggcagccactcctagagcccctggaactctggcccaaggctctctgactgacgccttctcggattaacggctgaagactgatgctgcccgatcaccttggaagccctgtagaccatcatggatgccgagcttcaggtaactctcacagtggaaggtaagtccgtccccctagtcaatatggaggctacccactccacattaccttcttttcaagggcctgtttcccttgcctccataactgttgtggctattgacggccaggcttctaaaccgctgaaaactcccccactctggtgcgaacttggacaacactcttttatgcacttttttttagtcatccccacctgcccagttcccttattaggccgagatattttaaccaaattatctgcttccctgactattcctggactacagccacgtctcattgccgcccttcttcccagtccaaagcccccttcgcctcttcctctcatatccccccaccttaacccacaagtatgggacatctctactccttccctggcaaccaatcacatgcccattaccatcccattaaaacttaatcacccttaccccgctcagcgccaatatcccatcccacagcacgctttgaaaggattaaagcctgttatcacttgcatgctacagcatgggcttctaaaacctataaactctccgtacaattcccccattttacctgtccaaaaaccagacaagtcttacagattagttcaggatctgcgccttatcaaccaaattgttttgcctatccatcctgtggtgccaaacccgtacactcttttgtcctcaataccttcctccacaactcactattccgtgcttgatcttaaagatgctttttccactattcccctgcaccccttgtcccagcctctctttgctttcacttagactgaccctgacacccattaggctcaacaaattacctgggctgtactgccacaaggcttcacagacagcccccgttacttcagtcaagcccaaatttcatcctcatctgttacctatcttggcataattctcataaaaacacacgtgctttccctgctgatcatgtccaattaatctcccaaacctcaatcccttacaaaacaacaatgcctttgcttcgtaggcatggttagtgcggtcagaattcttacacaagagccaggactgcaccctgtagcctttctgtccaaacaacttgaccttactgttttagcctagccctcatgtctccatgcagtggctgctgccaccctaatatttttagaggccctcaaaatcacaaactatgctcaactcactctctacatttctcataacttccaaaatctattttcttcctcatacctgatgcatatactttctgctccccggctccttcagctgtactcactctttgttaagtcccacaattaccattgttcctggcccagacttcaatccggcctcccacattatttctgataccacacctgaccctcatgacggtatctctctgatccacctgacattcaccccattcccccatatttccttctttcctgttcctcaccctgatcacgcttgatttattgatggcggttccaccggacctaatcgccacacaccagcaaaggtaggctatgctatactacaagccactagcccgcctcttagaacctctcattttctttccatcgtggaaatctatcctcaaggaaataacttctcagtgttccatctgctattctactactcctcaggaattattcaggccccctcccttccctacacatcaagctcgaggatttgcccccacccaggactggcaaattagctttactcaacatgccctgagtcagataactaaaatacctcttagtctaggtagacactttcactggataggtagaggcctttcctacagggtctgagatggtcaccagtcatttcttctcgtctgtcagacataattcctcagttcagccttcccacctctatacagtctgataacagaccagcctttattagtcaaatcagccaagcagtttttcaggctcttagtattcagtgaaacctttatatcccttacagtcctctgtcttcaagaaaagtacaacggactaaaggtcttttaaaaacacacctcaccaatctcagccaccaacttagaaaggactggacaatacttttaccactttcccttctcagaagtcagacctgtcctcagaatgctacaaggtacagcccatttgagctcctgtatagacgctcctttttattaggccccagtctcattccagacaccagactaacttagactgtgccccaaaaaaacttgtcatccctactatcttctgtctagtcatacttctattcaccattctcaactaatcatacatgccctgctcttttttactctgccggtttacactgtttctccaagccgtcacagctgatatctcctggtgctatccccaaactgccactcttaactcttgaagtaaataaataatctttgctggcaggactatgctgaatctccttaggcactctctaatcagatgtcctgggtcctcccaattcttagtcctttaatacctgtttttctccttctcttattccgtttagtttctcaattcatacaaaactgtatccaggccatcaccagtaattctgaatgacaaatgtttcttctaacaaccccacaatatcaccccttaccagaaaatcttccttcagcttaatctctcccactctaggttcccacgacgcccctaatcctgctccaagcagccctgagaaacatcgcccattatctctccataccacccccaaaacattttcaccgtctcaacactttaccactatttcgttttatttttcttattaatataagaagacaggaatgtcaggcctctgagcccaagctaagccatcatatcccctgtgacctgcagatacacatccagatggccggtgcctgccttaactgatgacattccaccacaaaagaagtgaaaatggcctgttcctgccttaactgatgacattgtcttgtgaaattccttctcctggctcatcctggctcaaaagctccctcactgagtaccttgtgacccccactcctgccagagaacaaccccccttcttcctttacctacccaaatcctataaaacggccccaccccatctcccttcgctgactctcttttcggactcagcccacctgcacccaggttaaataaacagctttattgctcacacaaagcctgtttggtggtctcttcacagggatgtgcatgaaa

SEQ ID NO: 408 - DNA, 5642 bp, Homo sapiens
gtcaggcttctgagcccaagctaagccatcgtatcccctgtgacctgcacatacacatccagatggccggttactgccttaactgatgacattcctccaaaaaagaagtgaaaatggcctgttcctgccttaactgatgacattatcttgtgaaattccttctcctgggtcaaaagctcccttactgagcaccttgtgacccccacccctgcccgccagagaacaacccctttgactgtaattttcctttacctacccaaatcctataaaacggccccacccctatctcccttcactgactctcttttcggactcagcccgcctgcacccaggtgaaataaacagccttgttgctcacacaaagcctgtttggtggtctcttcacatggtcgcgcatgaaatttggtgccgtcactcagatcaggggacctcccttgggagatcaatcccctgtcctcctgctctttgctccatgagaaagatccacctatgacctcaggtcctcagaccgaccagcccaaggaacatctcaccaatttcaaatccagtaagcggcctctttttactctcttctccaccctctctcactatccctcaacctctttctcctttcaatcttggcaccacacttccatctctcccatctcttattttcaattcctttcattttctggtagagacaaaagagacacattttttccgtggacccaaaactccggcgccagtcacagactcaggaaggcagccttcccttggtgtttaatcattgtggggacacctctctgattattcacccacgttccactggtgtctgatctccacggagacgcctgccttgatcattcacccacgttcccttggtggcaagtcaattgcggggacgcctgctttggctgctcaaccacgttgcagcccagggctgctccccaccaccttctctgtgtctctatccttctctttaaacttgcctcctttactatgggcaaccttccaccctccattcccccttcttctcccttagcctgtgttcttaaaaacctaaaacctcttcacctcacacctgacctgaaacctaaatgccttatttttttctgcaatgctgcttgaccccaatacaaactcaacagtggttccaaatagccagaaaatggcactttcaattattccatcctacaaggtctaaataattcttgtcgtaaaatgggcaaacggtctgaaatgcctgacgtccaggcattcttttacacatcggtccctccctagtctctgttcccaatacaactcgtcccaaatcttccttctttccctcctgcctgtcccctcagtcccaaccccaagcgtcgctgagtctttctaatcttccttttctacagacccatctgacctctcccctcctcgccaggctgagctaggtcccacttcttcctcagcctccgctcctccaccctataatcattttatcacctcccttcctcacacccggtccagcttacagttttgttctgtgactagccctcccccacctgcccagcaatttactcttaaaaaggtggctggagctaaaggcgtagtcaaagttaatgctcctttttctttatcccaaatcagatagcatttagactctttctcatcaaatataaaaacccagcccagttcatggcagcaaccctgagatgctttacagccctagatcctaaaaggtcaaaaggccgtcttattctcaatatacattttattacccaatctgctcccgacatttaataaaactccaaaaattaaattccggccctcaaaccccacaacaggacttaattaaccttgccttcaaggtgtacaacaatagagtagaggcagccaagtagcaacatatttctgagttgcaattccttgcctccaccgtgagacaaaccccagccacatctccagcacacaagaacttccaaatgcctcaaccacagtggccaggcattcctccaggcctgcctcccctaggagcttgctacaagtgccagaaatctggccaccaggccaaggaatgtccacagcccaggattcctcctaagccgcgtcccatctgtgtgggaccccactgaaaatcggactgttcaactcacctggcagccactcccagagcccctggaactctggcccaaggctctctgactgactccttcccagatcttcttggcttagcggctgaagactgatgctgcccgatcgcctcagaagccccgtagaccatgatggacaccgagctttaggtaactctcacagtggaagataagtccgtccccttcttaatcaatacggaggctacccactccacgttaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggccgagacactttaactaaatgatctgcttccctgactattcctggactatagctacatctcattgctgcccttcttcccaatccaaagcctcctttgtgtcctcctcttgtatccccccaccttaacccacaagtataggatacctctactccctccttggtgaccgatcatgcaccccttaccatctcattaaaacctaatcacccttaccccgctcaatgccaatatcccatcccacagcacgctttaaaaggattaaagcctgttatcactcgcctgctacagcatggccttttaaagcctataaactctccttacaattcccccattttacctgtcctagaaccagacaagccttacaggttagttcaggatctgcgccttatcaaccaaattgttttgcctatccaccccgtggtgccgaacccatacactctcctatcctcaatacctccctccacaacccattattctgttctggatctcaaacatgctttctttactattcctttgcacccttcatcccagcctgtcttcgctttcacttggactgaccctgacacccatcaggctcagcaaattacctgggctgtactgcctcaagtcttcacagacagcccccattacttcagtcaagcccaaatttcttcctcatctgttacctatctcagcgtaattctcataaaaacacacgtgctctccctgctgatcatgttcagctgatctctcaaaccccgagaactacaaaacaacaactcctttccttcctaggcatggttggatactttcgactttagatagctggttttgccatcctaacaaaaccattatataaactcacaaaaagaaacctagctgaccccatagatcctaaatcctttccccactcctctttccattccttgaagacagctttagaggctgcccccaccctagctctccctgatttatcccaacccttttcattacacacagctgaagtgcagggctgtgcagtcaggattcttacataaggaccgggatcatgtcctgtagcctttttatccaaacaacttgaccttactgttttgcccagccctcaagtctgcgtgcagcggccgccgctgccctaatacttttagaggcccttaaaatcacaaactatgctcaactcactctctgcagttctcataacttccaaaatctattttcttcctcacacctgacacatactttctgctccccggctccttcagctgtactcactctttgttaagtctcccacaattaccatcgttcctggcccggacttcaatccagcctcccacattattcctgataccacacctgacccccatgactctatctctctgatccacctgacattcaccccatttccccatatttccttcttccctgtttctcaccctgatcacacttggtttattgatggcagttccaccaggcctaatcgccacacaccagcaaaggcaggctatgctatagtacaagccactagcccacctcttagaacctctcatttcctttccatggtggaaatctatcctcaaggaaataacttctcagtgttccatctgctattctactactcctcagggattattcaggcccccttccttccctacacatcaagctcggagatttgcccccatccaggactggcagattggctttactcaacatgccccgagtcagataactaaaatacctcttagtctaagtagacattttcactggatgggtagaggcctttcctacagggtctgaggaggccaccacagtcatttcttcccttctgtcagacataattcctctgttcagccttcccacctctatccagtctgataacagaccagcctttattagtcaaatcagccaagcagtttttcaggctcttggtattcagtgaaacgtttatatcccttacagtcctcagttttcaggaaaagtagaacagactaatggtcttttaaaaacacacctcaccaagctcagccaccaacttaaaaaggaatggacgatacttttaccactttcccttctcagaattcaggcctgacctcagaatgctagaaggtacagcccatttgagctcccgtatagacgctcctttttattaggccccagtctcatcccagacaccagaccaacttagactgtgcccccaaaatcttgtcatctctactattttctgtctagtcatactcctattcaccagtttcaactactcataaatgccctgctcttgtttacactgccagtttacactgtttctccaatctatcacagctgatatctcctggtgctatccccaaaccgccactcttaaagtgaataaataatctttgctggcaaggctatgctgaacctccttaggcactctctaattagatgtcctaggtcctcccaattcttagtcctttaatacctgtttttctccttctcttgttctgtttagtttttcaattcatacaaaactgtatccaggccatcaccaataattctacacaacaaatgtttcttctaacaaccccacaatatcaccccttaccacaaaatcttccttcagcttaatctctcccactctaggttcccacgcctcccctaatcccgcttgaagcagccttgagaaacatcgcccattctctctccataccacccccaaaaattttcgccgccccaacactttaccactatttctttttatttttctcattaatataagaagacaggaatgtcaggcctctgagcccaagctaagccatcatatcccctgtgacctgcacatacacatccagatggctggttcctgccttaactgatgacattccaccacaaaagaagtgaaaatggcctgttcctgccttaactgatgacattctcttgtgaaattccttctcctggctcatcctggatcaaaagctcccctactgagcaccttgtgacccccactcctgcctgccagataacaacccctttgactgtaattttcctttatctacccaaatcctgtaaaacagccccacccctatctcccttcactgactctcttttcggactcagcccacctgcacccaggtgaaataaacagccttgttgctcacacaaagcctgtttggtggtctcttcacacggacgtgcatgaaa

SEQ ID NO: 409 - DNA, 1295 bp, Homo sapiens
gtggggaaaagaaagagagatcagactgttactgtgtctatgtagaaagaagtagacataagagactccattttggtctgtactaagaaaaattcttctgccttgagatgctgttaatctgtaaccctagccccaaccctgtgctcgcagagacatgtgcggtgttgagtcaaggtttaatggatttagggctatgcaggatgtgctttgttaaaaaagtgcttgaaggcagtatgcttgtccatggaatactatgcagccataaaaaaggatgagttcatgtcctttgcagggacatggatgaatctggaaaccatcattctcagcaaactatcacaaggacaaaaaaccaaacaccgcatgttcttagtcataggtgggaattgaacaatgagaacacttggacacaggagggggaacatcacacaccggggcctgtcatggggtggggggagggatagcattgggagatatacctaatgtaaatgacgagttagtgggtgcagcacaccaacatggtgcatgtatacacgtgtaacaaacctgcacgttgtgcacatgtaccctagaacttaaagtataataataataataaaaaaagtcatcaccattctctaatctcaagtacccagggacacaatacactgcggaaggccgcagggacctctgccctggaaagccaggtattgtccaaggtttctccccatgtgatagcctgagatatggcctcgtgggaagggaaagacctgaccgtcccccagcccgacacccgtaaagggtctgtgctgaggaggattagtgaaagaggaagtcctctttgcagttgagataagaggaaggcatctgtctcctgctcgtccctgggcaatggagtgtctcggtgtaaaacccgattgtatgttctatttactgagaaaagagaaaaccgccttaaggctggaggtgagacaggctagtggcaatactgctctttaatgcaccaagatgtttgtatacgtgcacatcagggcacagcacatttccttaaacttatttatgacacagagacctttgttcacatgttttcctgctgaccctctctccactattaccctattgttctgccacatccccctctccgagatggtagagataatgatcaataaatactgagggaactgagagaccagtgccggcgcgggtcctccgtatgctgagcgccggtcccctgggcccacttttctttcctgtgctttgtctctgtgtcttatttcttttctcagtctctcgtcccacctgacgagaaacacccacag

SEQ ID NO: 410 - DNA, 3005 bp, Homo sapiens
gttaggcctctgagcccaagcttagccatcatatcccctgtgacctgcatgtatacatccagatggcctgaagcaagtgaagaatcacaaaagaagtgaaaatggccagttcctgccttaactgatgacttcccaccattgtgatttgttcctgccccaccttaactgagcgattaagcttgtgagattccttctcctggctcagaaccttccccactgagcgccttgtgatcccccccaccacccacctgcaagagaaaaaccccttttgactgtaattttccactatgcacccaaatcctataaaacagccccacccctatctccctttgctgactctctttgcgaactcagcccacctgcacccaggtgattaaaaagctttatttatcacacaaagcctgtttggtggtctcttcacacggacgcacatgaaatttggtgctgtgacttagatcaggggacctcccttgggagatcaatcccctgtcctcctgctctttgctccatgagaaagatccacctacaaccttgggtcctcagaccaaccagcccaaggaacatctcaccaattttaaatcaggtaagcggtctctttttactctcttctccaacctctctcactatccctcaacctctttctcctttcaatcttggcaccacccttcaatctctcccttctcttaatttcagtttctttccttttcactagagacagatgagactcattttatccgtgaacccaaaactccggcaccagtcatggactcaggaagacagtcttcgcttggtgtttaatcactgcggagacacctggttgattattcactcacatttcagaggtgtctgatcaccgtgggggcgcctgccttgatccttcacctcagtggcaagtaccacttacctggggggcaagcacccctcaccccttctctccatgtctctaccctctcttttctctgggcttgcctccttcactatggacaaccttccaccatccattcctccctcttctcccttagcctgtgttctcaagaacttaaaacctcttcaactcacacctgacctaaaacctttctccttatatcatctcaactccccccatatttggacctctcacaatgcaaactactattcctgtggccactcctttatgtatctcttggcaaagacccactagaatccccctgggtaacctttcaccttctcgatgttccttcactcttcatctccaaagcccaactacacacatcactgaaacaattggagccttccagctccgtattacagataagccctctgtcaatactggcaaacttaaaaacattagcagttattattgcttaggaagacacttaccctgtatttcactccatcattggctaccttccccttactcgtcagactctcctcccaggccctcttgttgtttatttgtacccagctccataaataacagtgaaaggttgctcataaacactcaatgttttcttatgcaccatgaaaatcaaacctccccctctacgcagttacctcatcagtccccattacaacctctgatggctgctgccctagctggatccctagaagtctgggcacaagacacatcttttagtactccttctcatctttttactttgcatttccagttttgccttgcacaaggtctcttcttcctctgtggatcctctacctacatgtggctacctgctaattggacaggcacatgcacactagttttccttactcccaaagttcaatttgcaaatgggactgaatagcttcctgttcccctcatgacactgacatgacacaagagagttattccactgattcccttgcttgtcggtttaggactttctccctccactattgctctcagtactggaatagcaggcatttcatcctctgtcacgacctttcgtagcctctctaatgacttctctgctagcatcacagacatatcacaaactctatcagtccttcaggcccaagttgactctcttgctgcatttggcctctaaaaccaccgaggccttgacttactcactgctgaaaaaggaggactctgtatatttttaaatgaagagtgttgtttttacctaaatcaatctggcctggtgtaagacaacataaaaaaactcaaggatagagcccaaaaactcatcaaccaaggaagtaattatgctgaacccccttgggcactctctaattggatgccatggatcctcccaattcttagtcctttaatacctgtttttctccttctcttatttggaccttgtgtcttccatttagtttttcaattcatccaaaaccatatccaggccatcaccaatcattctatacgacaaatgctccttctaacaaccccacaatatcaccccttaccgcaaaatcttccttcagctgaatctctcccactctaggttcccatgccacccctaatcccacttgaagcagccctgaaaaacatcacccattatctctccataccacccccaaaaatgttcactgccccaacacttcaatactattttatggggtttttttattgatataagaagacaggaatgtcaggcctctgagcccaaactaagccatcatatcccctgtgacctgcatgtatacatccagatggcctgaagcaagtgaagaatcacaaaagaagtgaaaatggccagttcctgcctcaactgatgacatcccaccattgtgatttgttcctgccccaccttaactgagcaattaaccttgtgagattccttctcctggctcagaacctcccccactgagcagcttgtgatccccgcctctgcctgcaagagaaaaaccccctttgactgtaattttccactacccacccaaatcctataaaatggccccaccccatctctcttcactgactttctttttggactcaacctgcctgtacccaggtgattaaaaagctttattgctcacacaaagcctgtttggtggtctcttcacacggacatgcatga

SEQ ID NO: 411 - DNA, 579 bp, Homo sapiens
ataataattgatctcagcgggcaccaagaaaaggcagtctcccaatagatagaaaacacccgaaactggtcatcagcagcttcccgataagatctcaggagttggatgagtgggctcaagcatatgcactaagaggcaaagtggcagagtttaactggcacataatcttcctctaggaacactctaaaagtaagagaaaaacacctcaaatgagcatgtgcacatttcattaaacccattgtgtacgcggcccctccgaagcactggcaggccactgtacatgtggacatcccaccccaagggaaaaatcaagggagaagaaatacaaatcccagaaccatgccaatgtataaaaccccaagtcaagggccaggcagagcacttagatctctcaagtcacccacttagccatcttccaagtgtactttacttcctttcgttcccactctaaaactttaataaacatttactcctgctctaaaacttgcttgggtctctcactcttctgcatgccccttggccaaattctttcctccaaggaggcaagaatcaagttgctgcagacctgtatggattcgc

SEQ ID NO: 412 - DNA, 572 bp, Homo sapiens
aattgaaactgtaaaactacaaatggttcatcaaatggagccccagatgcagtccatgactaagatccaccgtagacccccggaccggtctcccagcccatgctctggtgttaatgacatcgaaggcacccctcccaaggaaatctcagctgcacaacccctcctatgccccagttcagcaggaagcagttagagcagtcatcggccaacctccccaatagcacttgggttttcctgttgagagtggggactgagaggactagctggatttcctaggccgactaagaatccctaagcctagctgggaaggtaactacatccatctttaaacatggggcttgcaacttagctcacacccaaccaatcagagagctcactaaaatgctaattaggcaaaaacaggaggtaaagaaatagccaatcatctattgcctgagagcacagcgggagggacaaggatcaggatataaatccaggcattccagccagcaatggcaaccccctttgggtcgcctccttgtatgggagctctgttttcactctatttcactctattaaatcttgcacctgca

SEQ ID NO: 413 - DNA, 964 bp, Homo sapiens
gtgggggaaataaagagagatcaggctgttactgtgtctatgcagaaagaagaagacataagaaactccattttgttctgtagtaagaaaaattcttctgccttgagatgctattaatctgtaacgctagccccaaccctgtggtcacagaaatatttgctgtgttgactcaaggtttaatggatatagggctgtgcaggatgtgctttgttaaaaatgtgtttgcacgcagtatgcttggtaaaagtcatcacccttctctggtctcaagtacccagggacacaatgcactgtcgaaggccacagggacctctgcccaagaacgcctgggtattgtccaaggtttctccccactgagacagcctgagacatggcctcgtgggaagggaaagaccttaccgtcccccagcccgatacccataaagggtctgtgctgaggaggattagtgaaagaggaaggcctctttgcagttgagataagaggaaggcatctgtctcctgctcgtccccgggaatggaatgtcttggtgtaaaacccgaacgtacattctatttactgagatgggagaaaactgccttatggctggaggtgagacatgctggcgacaatactgctctttactgcactgagatgtttgtgtaaagtcaaacataaatctggcctacaagcacatcgaggcacagcacctttccttaaacttatttatgacacagagtcctttgttcacatgttttcctgctgaccctctccccaccctgccacatccccctcaccaagatagtagagatagtgatcaataaatactgagggaactcagagaccagagccggtgcgggtcctccatatgctgagcgctggtcctctgggcccactgttctttctctatactttgtctctgtgtcttatttcttttctcagtctctcatcacacctgatgagaaatacccacaggtgtggaggggc

SEQ ID NO: 414 - DNA, 3258 bp, Homo sapiens
tacactagctctccgtgactcatcccaacccttttcattacacacagctgaagtgcagcgctgtgcagttgaaattcttacacaaggaccaggatggcatcctgtagcctttttgtccaaacaacttgaccttattgttttaggttggctgttatgtctctgtgcagcagctgctgccatcctaatactttaaaggcccttaaaatcacaaactatgctcaactcactctctacagctctcataatttccaaaatgtattttcttcctcacacctgccacatatacattctgctccccggctccttctgctgtactctttgttgagtctcccacaattaccattgttcctggcccggacttcaatccagcctcccacattattcctgataccacacctgaccctcatgactgcatctctctgatccacctgacattcaccccatgtccccacatttccttcttcccagtttctcaccctgaccacacttagtttattgatggcagttccaccaggcctaattgccacacaccagcaaaagcaggctatgctatagtacaagccactagcctgcctcttagaacctctcatttcctttccatcgtggaaatctatcctcaaggaaataacttctcagtgttccatctgctattctactactcctcagggattcttcaggccccctcccttccctacacatcaagctcagggatttgcccccacccaggactggcaaattagctttactcaacgtgccccgagtcaggaaactaaaataactcttggtctaggtagacactttcactggataggtagaggcctttcccacagggtctaagaaggccaccacggtcatttcttcccttctgtcagacgtaattcctcagtttggctttcccacgtctatacagtcccatagcagaccggcctttattaatcaagtcagccaagcattttttcaggctcttagtattcagtgaaacctttatatttcttacagtccttagtcttcaggaaaggtagaacagactaatggtcttttaaaacacaccttaccaagctcagccaccaacttaaaaaggactggacaatacttttaccactttcccttctcagaattcaggcctgtcttcggaatgctacaaggtacagcccatttgttgcgggaagtcagggaccccaaacggagggaccggctgaagccatggcagaagaacgtggattgtgaagattttatggacatttattagttccccaaattaatacttttgtaatttcttatgcctgcctttactgcagtctctaaacataaattgtaaagattccatggacacttatcacttccccaatcaatatccttgtgatttcctatgcttgtctttgctttaatctcttaatcctgtcagccgagaagaatttatatcatctcaggaccctgtaataattgtattaactacacaaattgtacagcatgtgtgtttgagcaatatgaaatgtgggcaccctgaaaaaagaacaggataacagcaattgttcagggaataagagagataaccttaaactctgaccgccggtgagccgggcagaacagccatatttctcttctttcaaaagcaaatgggagaaatatcgctgaattccttttctcagcatggaacgtccctgagaaagagaatgcacacctaggggtaggtctctgaactggctccccgccgggcgtacctgtctcttatggtcgagattgcagaggtgaaataaactccagtctcccatagtgctcccaggcttattaggaagaggaaattcccgcctaataaactttggtcagaccggttgatctcaaaaccctgtctcctgataagatgttatcaatgacaatggtgccaaaacttcatcaacaattttaacttcacttcggtcctgtggtcctatgatcttgccctgtctccacttgccttgtgatattctattaccttgttaagtacttgatgtctgtcacccacacctattcgtatactccctccccttttgaaactccctaataaaaacttgctggtttttgtggcttgtggggcatcacggatcctaccaatatgtgatgtctcccccggatgcccagctttaaaatttctcttttttgtactctgtccttttatttctcaagccagttgacacttaggaaaatagaaaagaaactacgtgattatcggggcaggtcccccgatacccattggatctcctgtatagacgctcctttttattaggcccaagtctcattccagacacaagaccaacttggactgtgccccaaaaaacttgtcatccctactatcttctgtctagtcatactcctattcaccgttctcaactactcatatatgccctgctcttgtttacactggtggtttacactgtttctccaagccatcacaggtgatatctcctggtgctatccccaaaccaccactcttaactcttaaataaataatctttgctggcaaggctatgctgaacctccttaggcactctctaattagaggtcctaggtcctcccaattcttcgtcctttaatacctgtttttctccttctcttattccgtttagtttttcaattcatacaaaactgtatccaggccatcaccaataattctaaataacaaccccacaatatcaccccttaccacaaaatcttccttcagcttcatctctcccactcgaggttcccacgctgcccctaatcaaagcagccctgagaaacatcgcccattatctctccataccacccccagaaatttttcaccatcccaacactttaccactatttcattttatttttcttattaatgtacgaagacaggaacgtcaggcctctgagcccaagctaagccatcatatcccctgtgacctgcatgtacacatccagatggccgatttctgccttaactgatgacattccaccacaaaagaaatgaaaatggcctgttcctgccttaactgatgacattatcttgtgaaattccttctccttgctcatcctggctcaaaagctcccctactgagcaccttgtgacccccactcctgcctgccagacaacacccctttttcctttacctacccaaatctgataaaacggccccacccctatctcccttcgctgactctttttggactcagcccacctgcacccaggtgaaataaacagctttattgctcacacaaagcctgttttgtggtctcttcacacggatgcgcatgaaa

SEQ ID NO: 415 - DNA, 685 bp, Homo sapiens
ttacagtcggtaatcagatatgagcaaggcaggagaggacccaccctcaccaggaatgtcaggcaaacatcaggcaatgttcaggcagttgttaaactgtctctctataataataattggtcacaaccagcaccagggaagggctgtctctcaatagatagaaaatctgaaactggtgatcagcagcttcctgatgagatctcaggagttgggtgagtgggcccaagcatgtgcactaaaaggtaaaatagcagagtttaactgaaatatgaccttcctctaggaacacttaactggtaagggaaaatgcctcaagtgagcatgtgtacaacttcaataaacacactgcacatgcagccgctcccaagtgctagcaggccactgcacatgcagacagcccactccgcaggaagaatcacagaagtaaagcaaccctggaagctgccaacacataagaccccaagtcaaaaatcaaaccgtgcatttgaatctcaagttgcctgcttgaccctcttccacatgcactttacttttgttcctgctctaaaaccttttaataaactttcatgcctgctctaaaacttgccttggtgtctctctgccttacacccgtcagttgaattctttcttctaggaaggcaagaactgaggtggctgcagacccatgtggattcaccactgccaa

SEQ ID NO: 416 - DNA, 5700 bp, Homo sapiens
gtaaaaggatattaaccccagaggcaacaaaagaaattaaattagtggaagaaaaaattcagtcagcacaaataaatagatcccttagtctcactccaacttttgatttttgctactgcacattctccaacaggcatcattgttcaaaatactgatcttgtggagtggtcattccttcctcacagtacaattaagacttttacattgtacgtggatcaaatagctacattaattggtcagaaaaggttatgaatagtaaaattgtgtggaaatgacccagacaaaatagttgttcctttaaacaaggaacaggttagacaagcctttatcaattctggtgcatggcagattggtcttactaattttgtgggaattattgataatcattacccgaaaacaaaaatcttccagtttttaaaattgactacttggattctacctaaaattaccagacataaacctttagaaaatgctctgacagtgtttactgatggttccagcaatagaaaagcagcttacacagggccaaaagagcgagtcatcaaaactcaatatcaattggctcaaagagcagagttggttgcagtcattacagtgttacaagactttgatcaacctattaatattgtatcagattctgcatatgtagtgcaggctacaaaggatgttgagacagctctaattaaatatagcatagatgatcagttaaaccagcagttcaatttattacaacaaactgtaaaaaaaaaagaaatttcccattttatgttactcatattcgaggacacactaatttaccagggcctttaactaaagcaaatgaacaagctgacttactggtaccatctgcattcataaaagcacaagaacttcatgctttcactcatgtaaatgcagcaggattaaaaaacaaatttcatgttgtagggtccagccccatagggtcggtgggtctctccccatgtgcagagatgagagagtgtagaaataaagacacaagacaaagagataaaagaaaaggcagctgggcccgggggaccactaccaccaatgcacggagaccggtagtggccccaaatgtcgggctgcgctgttatttattggatacaaagcaaaaggggcagggtaaagcgtgtaagtcatctccagtgataggtaaggtcacgtgggtcacgtgtccactggacagggggcccttccctgcctggcagccgaggcagagagagagaggagacaaagagaaagacagcttacaccattatttttgcatatcagagacttttagtactttcactaatttactactgctttctagaaggcagagccaggtgtacaggatggaacatgaaggcggactaggagcatgaccaccgaagcacagcatcacagggagacggttaggcctccggataactgcgggcgagcctgactgatgtcaggccctccacaagaggtggaggagcagagtcttctctaaactcccccggggaaagggagactcccttccccagtctgctaagtagcgggtgttttcccttgacacttatgctaccgctagaccacggtccgcctggcaacgggcgtcttcccagacgctggcgtcaccactagaccaaggagccctctggtggccctgtccgggcataacagaaggctcgcactcttgtcttctggtcacttctcactgtgtcccctcagctcctatctctgtatggcctggcttttcctaggttatgattatagagcgaggattattataatattggaataaagagtaattgctacaaactaatgattaatgatattcatatataatcatgtctatgatctagatctggtataactattcttgttttatattttattatactggaacagctcgtgtccttgctctcttgcctcagcgcctgggtggcttgccgcccacagatgtcacatggaaacaggcaaaaaatattctacaacatggtacccagtgtcaagtcctacacctgcccactcaagaggcaggagttaatcccagaggtctgtgtcctaatgcattatggcaaatggatgtcacacatgtaccttcatttggaagattatgatgtgtccgtgtaacagttgatacttattcacatttcatgtgggcaacttgccagacaggagaaagtacttcccatgtgaaaaaacatttattgtcttgttttgctgtcatgggagttccagaaaaaatcaaaactgacaatggaccaggatattgtagtaaagctttccaaaaattcttaaatcagtggaaaattacacacacaacaggaattccctataattctcaaggacaggccatagttaaaaaaaactaatagaacactcaaaactcaattagttaaagagaagggggagacagtaaggagtgtaccactcctcagatgcaacttaatctagcattctatactttaaatgttttaaacatgtatagaaatcagactactacctctgcagaacatcttactggtcaaaagaacagcccacatgaaggaaaactgatttgataaaaagacaacaacaataagacatgagaaatagggaaggtggtaacttgggggagaggttttgcttgtgtttcaccaggagaaaatcagcttcctgtttagatacccactagacatttaaagttctacaatgaacccatcagagatgcaaagaaaagcacctccacggagatggaaacaccacaatcaaacaccatcgattcacaaggtgaacaaaatggtgatgtcagaagaacagatgaagttgccatccaccaagaaagcagagccgccgacttgggcacaattaaagaagctgacacagttaccaaaaaaaagcctagagaacacaaaggtgacacaaactccagagaacacgctgcttgcagctttgatgattgtatcaacggtggtaagtctccccttgcctgcaggggcagctgcagctaattatacctactgggcctatgtgcctttcccgcccttaattcgggcagtcacatggatggataatcctattgaagtatatgttaataatagtgcatgggtacctggccccacagatgatcgttgccctgccaaacctgaggaagaaggaatgatgataaatatttccactgggtatcgttatcctcctatttgcctagggagagcaccagcatgtttaatgcctgcaatccaaaattggttggtagaagtacctactgtcggtaccaccagtagattcacttatcacacggtaagtggaatgtctctcaggccacaggtaaattatttacaggacttttcttatcaatgatcattacaatttaggcctaaacaaaagccttgccccaaggtaattcccaaagaatcaaaaggcacagaagttttagtttgggaagaatgtgtggccgatagtgcggagatattacaaaacaatgaattcggaactattatagattggacatgtcgaggtcaattctaccacaattgcacaggacaaactcagtcatgtcccagtgcacaagtgagtccagctgttaacagtgacttaacagaaagtttagacaaacataagcacaaaaaattacagtctttctaccctttggaatggggagaaaaaggaatctctactccaagactaaaaataataagtcttgtttctggtcctgaacatccacaattatggatgcttactgtggcctcatattgcattagaatttgatctggaaatcaagctatataaagaagagatcgcaagccattttatactatcgacctaaattccagtctaacagttcctttgcaaagttgtataaagcccccttatatgctagttgtaggaaatatagttattaaaccagactcccaaactataacctgtgaaaactgcagattgtttacttgcattgattcgacttttaattggcagcaccatattctgctagtgagagcaagagaaggcgtgtgggtccctgtgtccatggactgaccgtgggaggcctcgccatccgtccatattttgactgaagtattcaaagccattttaaatagatccaaaatattctttaattgcagtgattatgggactaattgcagtcacagctacggcctctgtggcaggagtttcattgtactcttctgctcagacagtaaacttttttaattattggcaaaagaattctacaagattgtggaattcataatctggtattgatcaaaaattggcaaatcaaattaatgaccttagacacaatgttgtttggatgggagataggctcacgagcttgaaacatcatttctggttacactgtgactggaatatgtcacatttttgtattacatcctaagcctataatgagtctgagcatcattgggacatggttagatgccatctacaaggaagagaagatgatcttactttagacatttcaaaattaaaagaaaaatttttgaggcatcaaaaacccatttaaatttggtgccaggaactgaggcaatcgcgaaagctgctgatggcctcgcaaatcttaacccggtcacttgggttaaaaccatcgcaagttccactattgtaaatttcatattaatccttgtgttcctgttctgtctgttgttagtctgcaggtgtacccagcagctccgaagagacagcgaccattgagaatgggtgatgacgacgatggtggttttgtcaaaaagaaaagggggaaatgtggggaaaagaaagagagatcagactgttactgtgtctatgtagaaaaggaagacataagaaactccattttgatctgtattaagaaaaattgttctgctttgcgatgctgttaatctgtaactttagccccaaccctgtgctcacagaaacatgtgctgtattgaatcaaggtttaatggatttagggctgtgcagggtgtgccttgttaacaatatgtttgcaggcagtatgcccggtaaaagttatcgccattctccattctctgttaaccagggacacaatgcactgcggaaagccgcagggacctctgccctagaaagcctgggtattgtccaagtttccccccactgagacagcctgagatatggcctcatgggaaaagaaagaccttatatcccccaacccgacacccgtgaagggtctgtgctgaggaggagtagtgaaagagggaggcctctttgcagtcaagataagaggaaggcttctgtctcctgctcatttctgggaatggaatgcctcggtgtaaagccgaccattcattctattctgaggtaggagaaaaccgccctgtggttggaggtgagacatgctggcagcaatactgctctgtgactctttgctacactgagatgtttgtgtgaagagaaacataaatctagcctacgtgcacatccaggcacagtacctttccttgaacttattcatgacacagattcctttgctcacgtttccctgctgaccttctcgccaccatcaccctgttgccctgccacactcccctcacaaagatagtaaaaatagtgatcaataaatactgagggaactcagagaccagcgccggtgcgggtactcgcacactgagctccggttgtctgggcccactgctgtttctctatactttgtctctgtgtcttatttcttttctcagtttctcatctccacctgatgagaaacacccgcaggtgtggaggggcaggcccccttca

SEQ ID NO: 417 - DNA, 5663 bp, Homo sapiens
gtcaggcctctgagcccaagccaagccatcgcatcccgtgacttgcacatatacacccagatggcctgaagtaactgaagatccacaaaagaagtaaaaatagccttaaggatgacattccaccattgtgatttgttcctgccccaccctaactgatcaatgtactttgtaatctcccccacccttaagaagtttctttgtaattctccccacccttgagaatgtactttgtgagatccacccctgcccgcaaaacattgctcttaacttcaccgcctgacccaaaacctgtaagaactaatgataatccatctcccttcgctgactctcttttcggactcagcccgcctgcatccaggtgaaataaacagccgtgttgctcacacaaagcctgtttggtggtctcttcacacggacgcacatgaaatttggtgccgtgactcggatcgggggacctcccttgggagatcaatccccctgtcctcctgctctttgctccatgagaaagatccacctacgacctcaggtcctcagaccgaccagcccaaaaaacatctcaccaatttcaaatccagtaagcggcctctttttactgtcttctccagcttccctcactatccctcaacctctttctcctttcaatcttggcgccgcacttcaatctctcccttctcttaatttcagttcctttcattttctggtagagacaagggagacacgttttatccgtggacccaaaactccggcgccggtcacgggctgggaaggcagccttcccttggtgtttaatcattgcagggacgcctctgattattcacccacgtttcaaaggtgtcagaccacgcagggacgcctgccttggtccttcacccttagcggcaagtcccgcttttctgaggaaggggcgagtaccccaaccccttctctccttgtctctaccccttctgtgatttttctggggcaggggcaagaacccctcaaccccttctccttcacccttagcggcaagtcccgcttttctaggtggcaagaacccccaatcccttatttccacaccccaatctcttatctctgtgccccaatcccttatttccgtgccccaaccccccttcccgcttttctggagggtaacaaccccgaaccccttccctccatgtctctacgctctcttttctctgggtttacctccttcactatgggcaaccttccatcctccattcctcctccttctcgcttagcctgtcctcaagaacttaaaacctcttcaactcacacctgacctaaaacctaaatgcattattttcttctgcaacaccacttggccccaatacaaacttgacaatggctctaaatggccagaaaagggcactttcgatttctccatcctacaagacctaaataatttttgtagaaaaatgggcaaatggtctgaggtgccttacgtccaggcatttttcacacttcactccctccctagcctctgttcccaatgcgattcctcccagatcctcctttccctcctgcctatcccctcagtcccaaccccaagcgtcgctgagtttttccagtcttccttttctacagacccatctgacctttcccctcctccccaggctgctcgtcgccaggccgagctaagtcccaattcttcctcagccccaactcctccaccctataatccttctatcacctcccctcctcacacctggtctggcttacagtttagttccgcgactagctcttccccacctgcccagcaatttactcttaaaaagatggctagagctaaaggcatagtcaaggttaatgctcctttttctttatcccaaatcagatagcatttaggctctttttcatcaaatataaaaatccagcccagttcatggctcgtttggcagcaactctgagacgctttacagccctagaccctaaaaggtcaaaaggccgtcttattctcaatatacattttattacccaatctgctcccaacattaaataaaactccaaaaattagaatctggcactcaaaccccacaacaggacttaattaacctcaccttcaaggtgtacgataatagaataaagttgcaattccttgcctccactgtgagacaaaccccagccacatctccagcacacaagaacttccaaacgcccgaaccgcagcggccaggggttcctccagaacctcctcccccaggagcttactacaagtgccagaaatctggccaccaggccaaggaatgcccacagcccaggattcctcctaagccgtgtcccatctgtgcgggaccccactgaaaaatcggactgttcaactcacctggtagccacttccagagcccctggaactctggcccaaggctctctgactccttcccagatcttctcagcttagcggctgaagactgacactgcccaatcgcctcggaagccccctagaccatcacggatgccaagcttcgggtaactctcacagtggaggttaagtccgtcccttcttaatcaatacggaggctacctgctccacattaccttcttttcaagggcctgtttcccttgcttccataactgttgtgggtattgacggccaggcttctaaacctcttaaaactccccaactctcgtgccaacttggacaacactcttttatgcactctttgttagttatccccacctgcccagttcccttattaggccgagatattttaaccaaattatctgcttccctgactattcctggactacagccacatctcattgccgcccttctccccaacccaaagcctccttcgtgtcttcctctcatatccccccaccttaacccacaagtatgggacatctctactccttccctggcaaccgatctcatgcccattaccatcccattaaaatctaatcacctttaccccactcaacgccaatatcccatcccacagcatgctttaaaaggattaaagcctgttaccactcgcctgctacagcatgggcttctaaaacctataaactctccttaccattcccccattttacctctcctaaaacgagacaaggcttacaggttagttcagaatctgcaccttatcaaccaaattgttttgcctatccaccccgtggtgccaaacccatatactctcctatcctcaatacctccctctactacccattattctgttctggatctcaaacatgctttctttactattcctttgcacgcttcatcccagcctctctttgccttcacttagactgaccctgacacccattaggctcagcaaattgactgggctgtactgccgcaaggcttcacagacagcccccattacttcagtcaagcccaaatttcatcctcatctgttacctatctcggcataattctcgtaaaaacacacgtgctctccctgctgatcgtgtccgattaatctcccaaacctcaatcccttactaaagaacaactcctttccttcctaggcatggttagtgcggtcagaattcttacacaagagccaggaccacaccgggtagcctttctgtccaaacaacttgaccttactgttttagcctagccctcatgtctgcatgcagtggctgccgctgctttaatactgttagaggccctaaaaatcacaaactatgctcaactcattctctacatttctcataacttccaaaatctattttcttctcacacctgacgcatatactttctgctccccggctccttcagctgtactcactctttgttaagtcccacaattaccattgttcctggcccggacttcaatccggcctcccacattattcctgataccacacctgacccccatgactgtatctctctgatccacctgatattcaccccatttccccgtatttccttctttcctgttcctcaccccgatcacacttgatttattgatggcagttccaccaggcctaatcgccacacaccagcaaaggcaggctatgctatagtacaaaccactaccccgcctctcagaacctctcatttcctttccatcatggaaatctatcctcaaggaaataacttctcagtgttccatctgctattctactactcctcagggattattcaggccccctctcttccctacacatcaagctcgaggatttgccccgacccaggactggcaaattagctttactcaacatgtcccgagtcaggaaactaaaatacctcttagtctaaatagacactttcactgaataagtagaggcctttcctacagggtctgagaaggacaccacagtcatttcttcccttctgtcagacataattcctcagtttagccttcccacctctatacagtctgataacagactagcctttattagtcaaattagccaagcagtttttcaggctcttagtattcagtgaaatctttatatcccttatggtcctctgtcttcaagaaaattagaatggacaaaaggtcttttaaaaacacacctcaccaagctcagccaccaacttaaaaaggactggacaatacttttaccactttcgcttctcagaagtcagacctgtcctcaaaatgctacagggcacagcccatttaagctcctgtatagacactcctttttattaggccccagtctcattcgacaccagaccaacttagactgtgccccaaaaaaacttgtcatccgtactatcttttgtctagtcatactcctattcaccgttctcaactactcatacatgccctgctcttgtttacactgccggtttacgctgtttctccaagccatcacagctgatatctcctggtgctatccccaaactgccactctaaactcttgaagtaaataaataatctttgctggcaggactatgctgaatctccttaggcactctctaatcagatgtcctaggccctcccaattcttagaccttttatacctgtttttctccttctcttattccatttagtttctcaattcatacaaaaccgtatccagcccatcaccaatcattctatatgacaaatgtttcttcttacatccccacaataccaccccttaccacaagacctcccttcagcttaatctctcccactctaggttcccacgccacccctaatcccacttgaagcagccctgagaaacatcgcccattctctctccataccacccccccaaaattttcgctgccccaacacttcaacactattttgttttatttttcttattaatataagaaggcaggaatgtcaggcctctgagcccaagccaagccatcgcatcccctgtgacttgcacgtatacacccagatggcccgaagtaactgaagatccacaaaagaagtaaaaatagccttaactgatgacattccgccattgtgatttgttcctgccccaccctaactgatcaatgtactttgtaatctcccccacccttaagaaggttctttgtaattctccccacccttgagaatgtactttgtgagatccacccctgcccgcaaaacattgctcttaacttcaccgcctgacccaaaacctataagaactaatgataatccatctccctttgctgactctcttttcggactcagcccacctgcatccaggtgaaataaacagccgtgttgctcacacaaagcctgtttggtggtctcttcacacggacgcgcatgaaa

SEQ ID NO: 418 - DNA, 1732 bp, Homo sapiens
aaaaaaaagattaatcctagttgtcctggaggacttggagccactgtctgttggacttacttcacccatactgatatgtctgataggggtggagttcaagatcaggctagagaaaaacacgtaaaggaagtaatctcccaactgacctgggtacatagcacccctagcccctacaaaggactagatctctcaaaactacatgaaaccctctgtacccatactcgcctggtaagcctatttaataccgccctcactgggctccatgaggtctcagcccaaaaccctactaactgttggatgtgcctccccctgcacttcaggtcatacatttcaatccctgtacctgaacaatggaacaacttcagcacagaaataaacaccacttccgttttggtaggacctcttgtttccaatctggaaataacccatacctcaaacctcacctatgtaaaatttagcaatactatagacacaaccaactcccaatgcatcaggtgaataactcctcccacaggaatagtctgcctacccccaggaatatttttgtctgtggcacctcagcctatcgttgtttgaatggctcttcagaatctatgtgcttcctctcattcttagtgccccctatgaccatctacactgaacaagatttatacaattatgttgtacctaagccctgcaacaaaagagtacccattcttccttttgttatcagagcaggagtgctaggtggactaggtgctggcattggcagtatcacaacctctactcagttctactacaaactatcccaagaactaaatggtgacatggaatgggttgccgactccctggtcaccttgcaagatcaacttaactccctagcagcagtagtccttcaaaatcaaagagctttagacttgctaaccgccaaaaggggggggaacctgtttatttttaggggaagaatgctattattatgttaatcaatccggaatcatcaccgagaaaggtaaagaaatttgagatagaatacaacatagagcagaggagcttcaaaacactggaccttggggcctcctcagtcaatggatgccctggattctccccttcttaggacctctagcagcaataatattgttactcctctttggagcctgtatctttaacctccttgttaagtttgtctcttccagaattgaagctgtaaaactacaaatcattcttcaaatggagccccagatgctgtccgtgactaagatctaccacagacccctggaccagcctgctagcccatgctccgatgttaatgacatcaaaggcacccctcccaaggaaatctcaactgcacaacccctactatgccccagttcagcaggaagcagttagagccatcatcggccaacctccccaacagcacttgggttttcctgttgagatgggggactgacagacaggactagctggatttcctaggccgactaagaatccctaagcctagctgggaaggtgaccacttccacctttaaacacagggcttgcaacttagctcacacctggccaatcagatagtagagagagctcactaaaatgctaattagacaaaaaacaggaggtaaagaaatagccaatcatctattgcctgagagcacagcgggatataaacccaggcattcgagccggcaatggctaccctctttgggtcccctccctttgtatgggagctctgtcttcactattaaaccttgcaactgca

SEQ ID NO: 419 - DNA, 227 bp, Homo sapiens
tagtggtgtacgcagcccccagtcacgtaccccttgcttgctcaatcaatcacgatcctctcatgcagacccccttagagttgtgagcccttaaaagggacaggaattgctcgctcgggttgctcggctcttgagacaggagtcttgccgatgctcctggccgaataaaccccttccttctttaacctggtgtctgaggggttttgtctgcggttcttcctgctaca

SEQ ID NO: 420 - DNA, 701 bp, Homo sapiens
ttacagtaggtagttaggcagacatgagcagggcaggagagggtgctccctgccaccaggaaggtcagccgaccatcaggtgatggtcaggttgttgtcaactgtctctaaaataattggccacagccagcacaagggaaaggcagtctcccaataaatagaaaacacctgacactagtgatcagcagctgcctgataagatctcaagagttgggtgagtgggctcaagcatgtacagtaagaggcaaaatggtggagtttaactggtatatgacatttttctaggaacacttgactggcaagggaaaaacactcaagtgagcatgcacacatcttcagtaaacatactacccatgcagcccctcctgagtgctggcaggccattgtgcatgcagacagcctaccccaagggaagaatcaggggagaagagatgcaatcccccgggaagcatgccaacatataaaaccccaagtcaaaactcaaaccacacagttgatctctcaagttgtccacttggccctcttctgagtgtactttacttcctttcactcctgctctaaaacttcttaacaaactttcactcctgctctaaaacttgccttggtctctccctctgcctcatgcctcttggttgaattctttcttctgaagatgcaagaattgaggttgttgcagacctgtacaaattcactgctgctaa

SEQ ID NO: 421 - DNA, 436 bp, Homo sapiens
atcaggcctctgagcccaagccacgccaccgcatccctggtgacttgcacgtgtacgcccagatggcctgaagtaactgaagaatcacaaaagtgaaaatgccctgccccgccttaactgatgacattccaccacaaaagaagtgaaaatggccagtccttccttaagtgatgacattaccttgtgaaagtccttttcctggctcaaaaagctcccccactgagcaccttgcgacccccactcctgcccaccagagaacaaatcccctttgactgcaattttcctttatctacccaaatcctataaaacggccccacccttatctcccttcactgactctcttttccgactcagcccgcctgcacccaggtgattaagagctttattgctcacacaaagcctgtttggtggtctcttcacacagacgcgcatgaaa

SEQ ID NO: 422 - DNA, 2336 bp, Homo sapiens
gtcatggccctcaggcaagcggactttggaggctctggaaaagggaaagactgggcaaattgaatgcctaatagggcttgctttcagtgcagtctacaaggacactttaaaaaaaagattgtctgaatagaaataagccgcccactcatccatgcctcttatgtcaagggaatcactggaaggcccactgccccaggggatgaagttcctctgagtcagaagccactaaccagatgatccagcaacaggactgagggtgcccggggcaagcgccagcccatgccatcaccctcacagagccccaggtatgcttgaccattgagggccaggaggttaactgtctcctggacagtggcgctgccttctcagtcttactcttctgtgccagacaactgtcctcctgatctgtcactatctgaggggtcctaggacaggcagtcactagatacttctcccaggcactaagttgtgactggggaactttactcttttcacgtgcttttctaattatgcctgaaagccccactcctttgttagggagagacatcctagcaaaagcaggggccattatacacctgaatataggagaaggaacacacatttcttgtcccctacttgaggaaggaattaatcctgacaattaattcctgacaacagaaggacaatatggatgagcgaagaatgcccattcccttcaagttaaactaaaagattcaccttctttccctaccaaaggcagtacccccttagacctgaggcccaacaagtacttcaaaagattaaggacctaaaagcccaaggcctagtaaaatcatgcaatagtgcaatagtccctacaatacttcaattttaggagtacagaaacccaatggagagtggagattagtgcaagatctcaggattatcaatgaggctgctgtccctgtataaccagctgcacctaacccttatgctctgctttcccaaataccagaagaagcagaatggtttacagtcctggaccttaaggatgactttttctgcatcccttacatcctgactctcaattcttctttgcctttgaagatccttcgaacccaacgtctcaactcacctggactgttttaccccaaggtttcaggccatctatttggccaagcattagcccaagacttgagccagttctcatacttggacactctcgtcctttggtatgtgaatgatttacttttagcctcctgttcagaaactttgtgccatcaagccacccaagcgctcttaaacttcctcaccacttgtggctacaaggtttccaaaccaaaggctcagctctgctcacagcagtttaaatacttagggctaaaattatccaaaggaaccagggccctcagtgaggaatgtaaccagcctatactggcttatcctcatcccacaacgctggatactgccaaaggaacctgaaaatgcaggagacaatgctagctattcctgcgaacctctacaggatctgtgcctgctcttcaaatgacaaccgtgaggaaagtaactagaatcgtagatccccgtggccctcccttgtcacatttttctctttactgttctcttacccactttcactctcattgcacctcctccatgctgctgtactaccagtagttcccctcaccaagagcttctatggataatgcagcttcccagaaatactgacacctcattgtataggagtttttctaaaggaaaccccactttcaccccccgtacacatactcgcccagtaagcctatttaataccactctcactgggctccatgaagcctcagcccaaaaccctactaactgttggatgtgcctcaccctgcatttaggccatacatttcaatccctgtatctttaatctccttgttaagtttgtctcttccagaatcgaaggtgtaaaactacaaatcgttcttcaaatggagccccagatgcagtccatgactaagatctactgcggacccctggactggcctgctagccaatgctctgatgttgatgacatcgagggcacctctcccaaggaaatctcaactgcatgacccctgctatgccccaattcagcagaaagcagttagagcagtcgtcagccaacctccccaacagcacttgggttttcctgttgagagaggggactgagagacaggactagctggatttcctaggccgactaagaattcctgaacctagctggggaagctgaccacacccacctttaaacacagggcttgtaactcagctcacacctgaccaatcaggttgtaaagagagcccagtaaaataccaattaggctaaaagcaggaggtaaagaaataatcaa

SEQ ID NO: 423 - DNA, 8422 bp, Homo sapiens
gtcaggcctctgagcccaagccaagccatcgcatcccctgtgacttgcacgtatacatccagatggcctaaagtaactgaagatccacaaaagaagtaaaaacagccttaactgatgacattccactattgtgatttgttcctgccccaccctaactgatcaatgaactgatcaatgtactttgtaatctcccccacccttaagaaggttctttgtaattctccccacccttgagaatgtactttgtgagacccaccccctgcccgcaaaacattgctcttaacttcaccgcctatcccgaaacctataagaactaatgataatccaccacccttcgctgactctcttttcggactcagcccacctgcacccaggtgaaataaacagctttattgctcacacaaagcctgtttggtggtctctttacatggacacacatgaaatttggtgccgtgactcggatcgggggacctcccttgggaaatcaatcccctgtcctcctgttctttgctccatgagaaagatccacctacgacctcaggtcctcacaccgaccagcccaaggaacatctcaccaattttaaatcaggtaagcgacctcttcttactctctcctccaacctctctcactgtccctcaaccactttcttctttccactcttcaatctctcccttctcttaatttcaattcctttcattttccgggcgagacaaaggagacacgttttatctgtggacccaaaactccggcgccggtcacggactgggaaggcagccttcccttggtgtttaatcattgcagggacacctgattattcacccacgtttcaaaggtgtcagaccacgcagggacacctgccttggtccttcacccttagcagcaaatcccgctcttctggggaaggggcaagtaccccaatcccttctctccttgtctctatcccttctctgctttcctggggcaggggcaagtacccctcaaccccttctccttcacccttagcggcaagtcccgctttcctggggcaggggcaagtacccctcaaccccttctccttcacccttagcggcaagtcccgcttttctgggggaggggcaagtacccctcaaccccttatctttcacccttagtggcaagtcccacttttctagggggcaagaacccccaatcccttatttccgcacccctacctcatatctctgtgccccaatcccttatttccatgtcccgaccccttatttccatgcctcgacccctttccgtgcctcgactccttatttctgcaccccatcccttatttccatgccccgacctcttatctctgcgccccaaccccttttcccacttttctggcaggtaagaacccccgaaccccttccctccatttctctactctctcttctctaggcttgcttccttcactacaggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaagtcagaaaatggcactttgaatttttccatcctgcaagatctaaataattcttgtcttagaaaaggcaaacggtctgaggtgcctgatgtccaggcattctttaacacatcagtcccttcctagtctctgtgcccagtgcaactcatcccaaatcttccttctttccctcctgcctgtcccctcagtcccaaccccaagcgtcgctgagtctttctaatcttcctttctacagacccatctgacctctcccctcctcaccaggccgagctaggtcccaattcttcctcagcctccactcctccaccctataatctttttatcgcctcccctcctcacacctggtggggcttacagtttcgttccgtgactagccctcccccacctgcccagcaatttactcttaaaaaggtggctggagccaaaggcatagtcaaggttaatgctttttctttatcccaaatcagatagcgtttaggctctttttcatcaaatataaaaatccagcccacttcatgacttgtttggcagcaaccctgagacactttacagccctagaccccaaaaagtcaaaaggccgtcttattctcaatatacattttattacccaatctgctcccaacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaatcgcaacggccaggcgttcctccagaacctcctcccacaggagcttgctacatgtgccggaaatctggccactgggccaaggaatgcccgcagcccgggattcctcttaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcctgatcgcctcggaagccccctagaccatcacggaccccgagcttcgggtaactctcacagtggaaggtaagcccgtccccttcttaatcaatacggaggctacccactccacattacattcttttcaagggcctgtttcccttgcctccataactgttgtgggtattgacagccaggcttctaaacttcttaaaactccccaactctggtgccaacttagacaatactcttttaagcactcctttttaattatccccacctgcccagttcccttattaggctgagacactttaactaaattatctgcttccctgactattcctggactacagctatatctcattgccgcccttcttcccaatccaaagcctcctttgcattctcctcttgtatccccccaccttaacccacaagtataggacacctctactccctccttggcgaccgatcatgcaccccttaccatctcattaaaacctaatcacccttaccccactcaatgccaatatcccatcccacagcatgctttaaaaagactaaagcctgttatcacttgcctgctacagcatggccttttaaagcctataaactctccttacaattcccccattttacctgtcctaaaaccaggcaagccttacaagttagttcaggatctgcaccttatcaaccaaattgttttgcctatccaccccatggtgccaaacccatatactctcctatcctcaatacctgcctctataacccattattctgttctagatctcaaacatgctttctttactattcctttgcacccttaatcccagcctctcttcactttcacttggactgaccctgacacccatcaagctcagcaaattacctaggctgtactgctgcaaagcttcacagacagcccccattacttcaatcaagcccaaatttcttcctcatctgttacctatctcggcataattctcataaaaacacacgtgctctccctgccaatcatgtctgactgatctccaaaccccatcaccttctacaaaacaaaaactcctttccttcctaggcatggttagcatggtcagaattcttacacaagagccaggaccacaccctgtagcctttctctccaaacaacttgaccttactgttttagcctagtcctcatgtctgcgtgcagtggctgccgctgcattaatacttttagaggccctcaaaatcacaaactatgctcaactcactctctacagctctcataatttccaaaatttattttcttcctcacaccggacacatacactttctgctccccggctccttcagctatactcactctttgttgagtctcccacaattaccattgttcctggtctggacttcaatccggcctcccacattattccggataccacacctgaccctcatgactgcatctctctgatccacctgacgttcaccccatttccccatatttccttcttccctgtttctcaccctgatcacacttggtttattgatggcagttccaccaggcctaatcaccactcaccagcaaaggcaggctatgctgtagtatcttccacatctatcattgaggctaccactctgcccctctccactacctctcagcaagccgaactagttgccttaactcaagccctcactcttgcaaaaggactacgcgtcaatatctatactgattctaaatgtgcctttcatattctgcaccatcatgcagtcatatgggctgaaagaggtttcctcactacacaagggtcctccatcattaatgcctcttcaataaaaactctgctcaaggccgctttacttccaaaagaagctggggtcattcactgcaaggggcatcaaaaggcgtcagatcccattgctctaggcaatgcttatgctgataaggtggctagacaagcagctagctctccaacttctgtccctcacggccagtttttctccttcactttggtcactcccacctactccccctctgaaacttccccctatcaatctcttcccacacaaggcaaatggttcttagaccaaggaaaatatctccttccagcctcacaggtccattctattctgtcgtcatttcaaaacctcttccacataggttacaagccgctagcccgtctcttagaacctctcatttcctttccatcatggaaatctatcctcaaggagatcacttctcagtgttccatctgctattctactacccctcaaggattgttcaggcctcctcccattcctacacatcaagctcggagatttgcccctgcccaggactggcagattgactttactcacaagcctcgagtcagaaaactaaaatatctcttagtctgggtagacactttcactggatgggtagaggccttccccacagggtctgagaaggccaccgcggtcgtttcttcccttctgtcagacataattcctcggtttggccttcccacctctatacagtctgataacggaccggcctttattagtcaaatcacccaagcagtttctcaggctcttggtattcagtggaatcttcatatcccttaccatcctcaatcttcaagaaaggtagaacggactaatggtcttttaaaggcacacctcaccaagctcagcctccaacttaaaaaggattggacagtacttttacctcttgctcttctcagcatcacagcctgtcctcgagatgctacagggtacagtccttttgaacttttatatggacgcactttcttgcttggccccaacctcatcccagacaccagccctctaggcgactatcttccagtcctccagcaggctagacaggaaattcgccaggctgctaatcttctcttgcctactccagatccccagccatacgaagacaccctagctggacaatcagttcttgttaagaatctgacccctcaaactctacaacctcaatggaccggaccctacttagtcatctatagtaccctgactgccgtccgcctgcaggatcctccccactgggttcaccattccagaataaagctgtgtccatcggacagccagcctaatccctcctcttcctcctggaagttgcaagtactctcccctacttcccttaaactcactcgtatttctgaagaacagtaataacccttatgagcctaatacatcccttcattctattaggtctttttgtccttaccctacttttgcgacagggctttacgaagtcacccccaccacttaggccaagcccccccaaaaaaaactagtcatccctactatcttctgtccggtcatactcctattctccattctcaactacttacaaatgccctactcttgtttacaccgccggtttacactgtttcttcaagccatcacagctgatatctcttggtgctatccccaaactgccactcttaactccctcttagagtggatagatgatctttgctagcaaggcaccctccaatatttccaccctgatgaagttctattctttacttttatactcactcttattctcattcccattcttatgccaccctctaccgctccccagctacctccaccacactatcaactttacccattctctcctagccacttctaatccctccttagcgaacaactgctggctttgcatttccctttcttccagtgcctacacagctgtccccgccttacagacagactgggcaacatctcccatctccctacacctccgaacttcctttaacagccctcacctttaccctctgaagaactcatttactttctagacaggtccagcaagacttccccagacatttcacatcagcaagctgccgccctccttcacacttatttaaaaaacctttctccttatattaactctactccccccatatttggacctctcacaacacaaactactattcctgtggctgctcctttatgtatctctcggcagagacccactggaattcccctgggtaatctttcaccttctcgatgttcctttactcttcatctccgaagcccaactacacacatcactgaaacaattggagccttccagctccatattacagacaagccctctatcaatactgacaaacttaaaaacattagcagtaattattgcttaggaagacacttgccctctatttcactccatccttggctaccttccccttgctcatcagactctcctcccaggccctcttctcgtttacttatacccagccccaaaaataacagtgaaaggttgctcgtagatactcaacgttttctcatacaccatgaaaatcgaacctccccctctacgcagttaccccatcagtccccattacaacctctgacagctgcctccctagctggatccctaggaatctgggtacaagacacccctttcagcactcctcatctttttactttacatctccagttttgcctcacacaaggtctcttcttcctctgtggatcctctacctacatgtgtctacctgctaattggacaggcacatgcacactagtcttccttacccccaaaattcaatttgcaaatgggaccgaagagctccctgttcccctcatgacaccgacacgacaaaaaagagttattccactaattcccttgatggtcggtttaggactttctgcctccactattgctctcggtactggaatagcaggcatttcaacctctgtcacgaccttccgtagcctgtctaatgacttctctgctagcatcacagacatatcacaaactttatcagtcctccaggcccaagttgactctttagctgcagttgtcctccaaaaccgccgaggccttgacttactcactgctgaaaaaggaggactctgcatattcttaaatgaggagtgttgtttttacctaaatcaatctggcctggtgtatgacaacataaaaaaactcaaggatagagcccaaaaacttgccaaccaagcaagtaattatgctgaacccccttgggcactctctaattggatgtcctgggtcctcccaattcttagtcctttaatacccatttttcttcttcttttattcggaccttgtatcttccgtttagtttttcaattcatccaaaaccgtatccaggccatcaccaatcattatatacaacaaatgtttcttctaacatccccacaatatcaccctttaccacaagacctcccttcagcttaatctctcccactctaggttcccacgccgcccctaatcccgcttgaaacagccctgagaaacatcgcccactctctctccataccaccccccaaaaaattttcaccgccccaacacttcaacactattttgttttatttttcttataagaaggcaggaatgtcaggcctctgagcccaagccaagccatcgcatcccctgtgacttgcacgtatacatccagatggcctaaagtaattgaagatccacaaaaggagtaaaaacagccttaactgatgacattccactattgtgatttgttcctgccccaccctaactgatcaatgaactgatcaatgtactttgtaatctcccccacccttaagaaggttctttgtaattctccccacccttgagaatgtactttgtgagacccaccccctgcccgcaaaacattgctcttaacttcaccgcctatcccaaaacctataagaactaacgataatccaccacccttcgctgactctcttttcggactcagcccgcctgcacccaggtgaaataaacagctttattgctcacacaaagcctgtttggtggtctcttcacacggacacgcatgaaa

SEQ ID NO: 424 - DNA, 753 bp, Homo sapiens
gagagacaggactagctggatttcctaggccaactaagaatccctaagcctagctggaaggtgaccgcatccacctttaaacacggggcttgcaacttagctcacacccgaccaatcagagagctcactaaaatgctaattaggcaaaaacaagaggtaaagaaatagccaatcatctattgtctgagggcacaacgggagagacaaggatctggatttaaacccaggcatttgagccggcaacagcaaccccctttgggtcccctccccctccttttgtacgggagccctgttttcaccctattaaatcttgcaactgcactcttctggtccatgtttattacagctcgagctgagcttttgctcaccgtccaccactgctgtttgccgccgtcgcagacccgccgctgacttccatccctccagatatggaagggtgtccgctgtgcttccgatccagtgaggcgcccattgccactcctgatgaggctaaaggcttgccattgttcctgcacagctaagtgcctgggttcatcctaatcgaactgaacactagtcattgggttccacggttctcttccatgacccacggcttctaatagagctgtaacactcactgcatgacccaagattccattccttggaatccgtaaggccaagaaccccaggtcagagaacacgaggcttgccacaatcttggaagtggcctgccaccatcttgggagctctgtgagcaaggaccccctggtaaca

SEQ ID NO: 425 - DNA, 2471 bp, Homo sapiens
tgaggtcaaaattcatacacaagagccaggaccacaccctgtagcctttctgtccaaacaacttgaccttactgttttagcctagccctcatgtctgcatgcagtggctgccactgccttaataattttagaggccctcaaaatcacaaactatgctcaactcaccctctacagttctcataacttccaaaatctattttcttcctcacacctgacgcatatactttctgcccccctccactacctctcagcaagccgaactcagtgccttaactcgagccctcactcttgcaaaaggactacgcatcaatatttgtactgactaaatatgccttccatatcttgcaccaccatgctgttatataggctgaaagagatttcctcactatgcaaaggtcctccatcattaatgcctctttaataaaaatgcttctcaaagccgctagtcattcactgcaaaggccatcaaaaggcattagatcccatcgctcaggacaacacttatgctgataaggtagctaaaaaagcagccatcaaaaggcatcagatcccatcgctcaggacaatgcttatgctgataagatagctaaaaaaagcagctggtgttccaacttctatccctcaaggcagtttttcaccttctcatctggccactcccacctactcccccgctgaaacttccacctatcaatctcttcccacacaaggcaaatggtttaaaaggaaaatatctccttccagcctcacaggcccattctattctgtcgtcatttcataacctcttccatgtaggttacaagccgctagcctgcctcttagatcctctcatttcctttccatcgtggaaatctatcctcaaggaaatcacttctcagtgttccatctgctattctactactcctcaggcatttctcaggccccctcccttccctacacatcaagctcggggatttgcccccgcccagaactggcaaattgactttactcacctgcctcgagtcaggaaactaaaataccccttggtctgggtagacgctttcattcgataagtagaagcctttcccacagggtctgaggaggccaccgcggtcatttcttcccttctgtcagacataattccttggtttggccttcccacctctatacagtccgataacggactggcctttattggtcaaatcacccaagcagtttttcaggctcttggtattcagcgaaacctttatatcccttaccatcctcaatcttcaggaaaggtaggagagactaatggtcttttaaaaacacacctcacaaagctcagccaccaacttaaaaaggactggacaatacttttaccacttgcccttctcagaattcaggcctgtcctcagaatgctacaaggtacagcccatttgagctcttgtatagatgctcctttttattaggccccagtctcattccagacaccagaccaacttggactgagccccaaaaaccttgtcatccctactgtcttctgtctagtcatactcctattcactgttctcaactactcctaaatgctcgtgtttatactgctggtaaactgtttctccaagccatcacagctgatatctcctggtactatccccaaaccaccactcttaactccctcttaaagtaaataaataatctttgctggcagggctatgctgaacctccttaggcactctctaattggatgtcctaggcactctctaattggatgtcctaggtcctcccaattcttagtcctttaatacctgtttttctccttgtcttattccatttagtttttcaattcatacaaaaccgtatccaggccatcaccaataattctatatgacaaatgtttcttctaacaaccccacaatatcaccccttaccacaaaatcttccttcagcttaatctctcccactgtaggttcccacaccacccctaatcacgctggaagcagccctgagaaacatcgcccattatctctccacaccaacccccaaaatttttgccacccgaacactttaccactatgttgttttatttttcttattaatataagaagacaggaatgtcaggcctctgagtccaagctaagccatcatatcctctgtgacctgcaaatatacacccagatggcctgaaggaactgaagaatgacaaaagaagtgaaaatggcctgttcctgccttaactgatgacattaccttgtgaaattccttttcctggctcatcctggctcaaaagctccccaactgagcaccttgtgacccccaaccctgcccgctgagaacaaccccctttgactgtaattttcctttacctacccaaatcttataaaatggccccacccctatcgccctttgctgactctcttttcagactcagcccacctgcacccaggtgaaataaacagccttgttgctcacacaaagcctgtgtggtggtctcttcacatggactcgagtgaaa

SEQ ID NO: 426 - DNA, 692 bp, Homo sapiens
ttagagtaggtagctaggcagacatgagcagggcaagaaagccaccctcccacctaggaaggtcaggggaccatcaggtaatggtgagatggttgttacactgtctctctaaaataataattggttgcagtcagtgccagagaaaggcaattttctaatagacagaaaatacctggagctggtagtcagcagcttcctgataagatctcaagagttcggcaagtgggccccagcatacgcactaacaggcaaaatggtggagtttaactggtaagaggaaaatgcctcaaatgaggaccacttgactggtaagaggaaaatgcctcaaatgagcacacacacaacctcagtaaacacagtgcacatgcagcccctcccaagtgctggcaggccactgtacatgcagacagcccaccccaagggaagaatcagggaagaagaaatgcaaacctcagaatcatgccaatgtataaaaccccaggtcaagggctgaacactgcactcagatctttcaagatgcctgcttggccctcttccaagtgcactttacttcctttcgttcgttctctaaaacttttaaataaactttcactgctgctctaaaacttgccctagtctctcgctctgcactatgccccttagccaaattctttccactgaggaggcaagaactgagtttgctgcagacctgt

SEQ ID NO: 427 - DNA, 6143 bp, Homo sapiens
gtcaggcctctgagcccaagctaagccatcatatcccctgtgacatgcacatatacatccagatggcctaaagcaagtgaagaatcacaaaagaagtgaaaattgctggttcctgccttaactgatgacattaccttgtgaaattccttctgactcagaagctccccaactgagcaccttgtgacccccacccctgcctgccagagaacaaccccctttgactgtaactttccacgaactacccaaatcctataaaatggccccacctctatctccctttgctgactctcttttcagactcagcccacctgcacccaggtgattaaacagctttattgctcacacaaagcctgtttggtggtctcttcacatggacgtgcatgaaatttggtgccatgactcagatcaggggacctcccttgggagatcaatcccctgtcctcttgctctttgctccatgagaaagatccacctacgacctctggtcctcagaccgaccagcccaaggaacatctccccaattttaaattgggtaagcagcctcttttcactctcttcaccaacgtctcttaccatctctcaacctcttactcctttcaatcttggtgccatccttcaatatctcttttctcttaatttcaattcctttccttttctagtagagacagaggagatgcattttatccatgaacccaaaactccagcaccagtcacagactcaggaagacagtcttcccttggtgtttaatcactgcagggaagcctgcctgattattcacccacatttcagaggtgtctgatcatcgtggggatgaatgcctttatccttcacccttaggggcaagcaccactttcctgtggggcaagcaccccctacctcttctttccatgtttctaccctctcttttctctgggcttacctccttcactatgggcaaccttccaacctccattcctcccttttctcccttagcctgtgttctgaagaacttaaaacctcttcaactcacacctgacctaaaacctacgtgacttattttcttctgcaatgccgcgtaaccccaatataaactcgacaatggttccaaatagccagaaaatgacaatttcaatttttccatcctacaagatctcaataatttttgttgtaaaatgggcaaacggtctgagatgcctcatgtccaggcattcttttacacatcggtcccttcctaatctctgctcccaatgtgacttgtgccaaatctttcttctttccctcccaccatcccctcattcccaaccccaagtgtcgcttagtctttttgatctttcttttctaccaacccatctgacctctcttctctccccagactgctccccacgtcgctccccaccaggctgaatcaggctccaattcttcctcagcctccactcccacaccctataatccttctatcaacttccctcctcacacctggcccagcttctttctgtgactagccctccgctacctgtccaacaatttcccttaaagaggtggctggagctaaaggcacagtcaaggttaatgttcctttttctttatccggcctctcccaaatcagttagcatttaggctttttttcatcaaatataaaaacccagcccagttcatgactcgtttggcagcaaccctgagatgctttacagccctagaccctgaaaggtcagaaggctttcttattctcaatatacattttattgcccaatctgctcctgacattaaataaagctccaagaccccataacaggacctaattaacctcacctccaaggtgtaccagaagagtaggggcagcgaagtagcaacatatttctgacttgcaattccttgcctccactgtgagagaaaccccagccacatctccagcacacaagaacttcaaaacacctaagccacagcagtcaggcattccttcaggaactcctcccccaggatcttgcttcaagtgccagaaatctggccactgggccaaggaatgcctgcagcccaggattcctcctaagccacgtcccatctgtgcaggaccccactggaaactggactgtccaacacgcccagcagccactcccagagcccctgaaactctggcccaaggctctctgactgattccttcccagatcttcttgactcagcggctgaagactaacactgcccaatcacctcagaagcttcctggaccatcacagacacttctggtaactcttacaagggagagtaagtccatccccttcttaatcaacatggaggctacccacttcacattgccttcttttcaatgacctgtttcccttgcctccataactgttgtgggtattgatggccaggcttttacacctcttaaaactccccaactctggtgccaacttggacaatattctttcatacactccttagttatccccacctgcccagctcccttattaggtcgagacattttaactaaattatctgcttccctgactattcctaggctacagccatacctcattgctgcccttcatatcctcctcttgtctctccctaccttaatccacaagtatagggcacctctacttccttcttggcaactaatcatgcaccccttaccattccattaaaatctaattacccttattccgctcaatgccaatatcccatcccacagcatattttaaaaggattaaagccttttatcacttgcctgttacagcatggccttttaaagcctaaaaactctcctgaaaatttgcccattttacctgtccaaaaaccagacaagtcttacaggttagttcaggatctgtgccttatcaacaaaattgttttgcctatccacccaatggtgccaaacccatatactctcctatcctcaatacctccctccacaacccattgttcggttctggatctcaaacatgctttctttaatattcctttgcacccttcatcccagcctctcttcgctttcacttggactgatcctgacaccatcaagctcagcaaattacctgggctgtactgctgcaaggcttcacggacagcccctattacttcagtcaagcccaaagttcttcctcatccattacctaccttggcataattcttcatgaaagcatacatgctctccctgctgattgtgtctggttaatctccaaaaccccaaccccttctaaaaaacagcaactcctttccttcctaggcatagttaggtactttcacctttggatacctagttttgccatcctgtctaaaccattatataaactcacaaaaggaaacctagctgaccccgtaaatcttaaatgctttccctactcctttccattccataaaaagccctagaagctgctcccacactagatctccctaactcattccaaccctttttcataacacacagccaaagtgcagggctgtgtggttagaattcttacacaagagctgggaccgcaccctgtagactttttgtccaaaaaacttgaccttactgttttagcctggccatcatgtctctgtgcagtggctgccactgccctagtacttttagaggccctcaaaatcgcaaactatgctcactcactctctacagttctcataacttccaaactcaattttcttcctcacacctgatgcatatactttctgctccctggctccttcagctatactcaccctttgctgagtctcccacagttaccattgttcctggcctggacttcaatccggcttcccacattattgcagataccacacctgacccccatgactgtatctctctgatccacctgacattcattcaatttccccatatttccttctttcctgttcctcatcctgatcacacttggttcatcaatggcagttccaccaggcctaatcgccactcaccagcaaaggcaggctatgctatagtatcttccacatctatcattgaggctacaactctgccctcctccactacctctcagcaagctgaattcattgccttaactcaggccctcattcttgcaaagggactatgcatcaatatttatgctgactctaaatatgcttccatatcctgcaccaccatgctgttatatgggctgaaagaggtttcctcactatgcaagggtcctccatcatttattcttctaatgaaaactcttctcaaggccactttactccaaaggaagctagagtcattcactgcaagggctgtcaaaaggcatcagatcccattgctcagggcaacacatatgctgataaggtagctaaagaagcagctagtgttccaacttctgtccctcatggccccactgaaattaactttactcatatgcccagagtcaggaaactaaaatacctctggatctgggtagacactttcactggatgagcagacgcctttccccacagggtctgagaagcccaccacagtcatttcttcccttctgtcatatataattccttggtttggccttcccacctctaaacagtctgataatggactggcctttattagtcaaatcacccaagcagtttctcaggctcttggtattcagtggaaccttcataccccttatcatcctcaatcttcaggaaaggtaaaacagactaatggtcttttaaaaacacaactcaccaagctcagcctccaacttaaaaaggactggacaatacttttaccacttgcccttctcagaatttgggcctgtcctcagaatgctacaaggtacagcccatttgagctcctgtatggatgctcctttttcataggccccagtctcattccagacaccagcccaacttgaaccgcaccccaaaaagtcgtcatccctaccatcttctgtctagtcatactcctattcaccattctcgactactcataaataccctgtccttgtttacactgccagtttgcacttttccttcaaaccatcataactggtatctcctggttttacctcaaaccgccatcctgaagtcactcttaaagtggataaataatgtttgctgacagggtacactccaatactttcaccctgatgaagttctattctttacttttatacttacttttattcttgttcccattcttatgtcaccctctacctctccccagctatctccaccacactatcaatttcactcactctctcctagccatttctaatcctttttgcaaacaatttctggctttgcatttctctttcctccaaaatcactgaggcctcgacttactcactgctaaaaaaaggggactctgtgtatttttaaatgaaaattgttgttttaacctaaatcaatctgtcctgctgtatgacaacacaaaaaaactcacggatagagccccaaaactcaccaaccaagcaaataattatgctgaacacccttgggcattctctaattggatgtcctgggtcctcccaattcttagtcctttaatacctgtttttctcctcttattcggaacttgtgtcttctgtttggtttctcaattcatacaaaactgtatccgggtcatcaccaatcattctatacaggaaatgctccttcttacaaaaccccacaatatcaccccttaccacaaaatcttccttcagcttaatctctcccactctaggttcccacaccacccctaatcccccttgaagtagccctgagaaacatcacccattatctctccatacctcctcccaaaatttttgccgccccaacactttaccactattttgttttatttttcttattaatgtaagaagacaggaaggtcaggcctctgagcccaagctaagccatcatatcccctgtgacctgcacatatacatccagatggcctgaagcaagtgaagaatcacataagaagtgaaaatggctggttcctgccctaactgatgacattatcttgtgaaattccttctcctggctcagaagctcccccactgagcaccttgtgacctccacccctgcctgccagagaacaaccccctttgactgtaattttccactgcctacccaaatcctataaaacagcccctacccatctcccttcgctgactctcttttcagattcagcctgcctacacccaggtgattaaaaagctttattgctcacacaatgcctgtttggtggtttcttcacacagacttgcatga

SEQ ID NO: 428 - DNA, 493 bp, Homo sapiens
gtaggagttcggtcagggtggtgggaaaaattgtagaaaaatgcaaaccttcttggaaggctgggaggttttacaaaagcttccggaaatggtttggcagaaggcagccagattctcttatctggtgcctgaaagcttaggtgagataacaaggggatgtaaagaaattgatctagataagttaagttagtttacttaggcctttaatcatccgtgcacaagactgctcactggcgcggagtggggggcgggggtgggggggccaccatgttaactacccacaagtgtgttgactcaaagtctttgacattaaatctgtactgaataaatgcccgcagggctggtcgaggctgcggctgctaactctttacagcaccctcctcggtgtctgggggcagcccggtcccctagccacgcggccaggcaaaaaacctgtgtctgcgtgcagttttttcatctgtcgtttggcagggtctgcgggtcagacccggca

SEQ ID NO: 429 - DNA, 651 bp, Homo sapiens
ttacagtgggtagttagatatgagcagggcaggagatagacctgcccaaaccggactgtcaggtgaccagcatgtgatgatggtgaggcagttgttacgttgtctctctaaaataataattggtagcagccagcaccaaggaaaggcagtctcccagtagaagaaatctgaaactggtgattggcagcttcccaataagatcttaggagttgggtgagtgggctcaagcatgcaaactacgaggcaaaatggcaaagtttaaccggtatttgaccttctaggaaagcctcaagtgagtatgcctacaacttcagtaaacgcactgaacacgtggcccctcccaagtgttagcaggccactgtgcatgtggagagcctgccccaatggaagaaatggggagaaggcaacaagaccccagaagcatgccaatgtatgaaccccaagtcaaaggtcaagctgtgcacttgaatctctcaagtcaccctcttggccctcttccaagtgtactttacttcctttcgttcctgttctaaaatgttttaataatttttgcttctgttcccacacttgcctcagtctcccactctgccttatgcccctcagtggaattctttcttctgagaacgcaagaactgaggttgctacagacct

SEQ ID NO: 430 - DNA, 7483 bp, Homo sapiens
gttaggcctctgagcccaagctaaggcatcgcatcccctgtgacctgcacatatacacccagatggcctgaagtaactgaagcatcacaaaagaagtgaaaatggcctgttcctgccttaactgatgacattccaccacagaagaagtgaaaatggctggtccttgccttaagtgatgacattaccttgtgaaattccttttcctggttcatcctggctcaaaaaagctcccccactgagcaccttgtgatccccactcctgcccaccagagaacaaccccactttgactgtaattttcctttacctacccaaatcttataaaatggccccacccctatctcccttcactgactctcttttcagactcagcccgcctgcacccaggtgattaaaaagctttattcctcacacaaagcctgtttggtggtctcttcacacgaacgcgagtaaaatttggtgccgtgactcggattgggggacctcccctgggagatcaatcccctgtcctcctgctctttgctccgtgagaaagatccacctacgacctcaggtcctcagaccaacctgcccaaggaacatctcaccaattttaaatctggtaagcagcctctttttactctcttctccaacctctctcactatccctcaacctctttctcctttcagtcttggcaccacacttcaatctctcccttctcttaatttcagttcctttccttttctggtagagacaaaggagacgtgttttatccgcggacccaaaactccggcgccggtcatggacttgggaaggcagccttaccttggtgtttaatcattgcagggatgcctgcctgattattcacccacgtttcagaggtgtctgaccatgcagggacgcctgccttggtccttcacccttagtggcaactaccgcttttctggagggcaagaacccccgaccccttctttccatgtctctactctctcttttctctgggcttgcctccttcactatgggcagccttccacctccattcctccttcttctcccttagcctgtgttctcaagaacttaaaacctcttcaactcacagctgacctaaaacctaaacaccttattttcttctataatgccgcttcaccccagtacaaacttgacagtggttccaaatagccagaaaactgcacttctgatttttccatcctacaagatctagataattgttgtcataaaataggcaaacggtctgaggtgcctgacatccaggcattcttttacacattgttccctccttactctctgttcccaatgcgacttgtcccagatcctccttctttccctcccgcctgtcctctcagtcccaaccccaagtgtcgctgagtctttctaatcttccttttctatatacccatctgacctctcccctcctccccaggctgctcctcgccaggtcccaattcttcctcagcctctgctcccccaccctataatccttttatcacctcccctcctcacacccagtctggcttacaatttcgttccgtgactagccctcccccacctgcccagcaatttcctcttaaaaaggtggctggagctaaaggcatagtcaaggttaatgctcctttttctttatccaacctctcccaaatcagttagtgtttaggctctttcaacaaatatgaaaaacccagcccagttcattgctcgttcggcagcaaccctgagacgctttacagccctagaccctgaaaggtcagaaggccatcttattctcaatatgcattttattttattacccaatctgctcccaacattaaataaagctccaaaaattaaattccagccctcaaaccccacaacaggacttaattaacctcaccttcaaggtgtacaataataaagtagaggcagccaagtagcaatgtatttctgagttgcaattccttgcctccactgtgagacaaaccccagccatatctccagcacacaagaactccaaatgcctgaaccatagctgccaggggttcctccagaacctcctcccccaggagcttgctacaagtgctggaaatctggccactgggccaaggaatgcccacagaccaggattcctcctaagccatgtcccatctgtgcaggaccccattgaaaatcggactgttcaactcacctggcagccactcccggggtccctggaattctggcccaaggctctctgactccttcccagattttcttggcttagcggctgaagactgacactgcccgatcgccttggaagcccctagaccatcacgggcgccaagcttcaggtaactctcacagtggagggtaagtccatccatcctcttcttaatcaatacagaggctacccactccacattaccttcttttcaaaggcctgtttcccttgcctccataactgttgtgggtattgacggccgggcttctgaacttcttaaaactccccaactctggtgccaacttagacaataatctttcagcactccttttagttatccccacctgcccagttcccttattaggctgagatattttaactaaattatctgcttccctgactattcttgggctacagccacatctcactgccgcccttcttcccaacccaaagcctcccttgcgtcttcctctcgtatccccccctccttaacccacaagtataggacatctctactccctccctggcaaccaatcacatgcccattaccatcccattaaaacctaatcacccttaccccgctcaatgccaatatcccatcctacagcatgctttaaaaggattaaagcctgttatcactcgcctgctacagcatagccttttaaagcctgtaaactccccttgcagttaccccatttcacctgtcctaaaaccagacaaagcttacaggttagttcagaatctgcgtcttatcaaccaaattgttttgcctatccaccctgtggtgccaaacccatatattctcctatcctcaatacctccctccataatccattattctgttctggatctcaaacatgctttctttactattcctttgcacccttcattccagcctctctttgctttcacttggactgacccgacagccatcaggctcagcaaattacctaggctgtactgctgcaaagcttcacagacagcccccattacttcagtcaagcccaaatttcttcctcatctgttacctatctcagcataattatcataaaaacacatgtgctctctctgctgatcatgtccggctaatctcccaaaccccaatcccttctacaaaacaacaactcctttccttcctaggcatggttagtgtggtcagaattcttacacaacagccagaaccgcgccctatagctttctgtccaaacaacttgaccttactatttcagcctagccctcatgtctgtgtgcagccgctgctgctgccttaatacttttagaggccctcaaaatcacaaactatgctcaactcactctctacagttctcataacttccaaaatctattttcttcctcatacctggtgcatatactttctgcttcccagctccttcagctgtactcactctttgttgagtctcccacagttaccattgttcctggcccggacttcaatccggcctcccacacctgaccctcatgactgtatctctctgatccacctgacattcactccatttccccatatttccttcttccctgttcctcaccctgatcatatttggtttattgatggcagttccaccaggcctaatcaccacacaccagcaaaggcaggctatgctatagtacaagccactacccgcctcttagaacctctcatttcctttccactgtggaaatctatcctcaaagaaatcacttctcaatgatcgatctgctattctactacccctcagggattgttcaggccccgtccctttcctacacatcaatctcagggatttgcccccacccaggactggcaaattgactatactcacatgccccaagtcagaaaactaaaatacctcttagtctgggttgacactttcactggatgggtagaggcctttcccacagggtctgagaaagccaccgcagtcatttcttcccttctgtcagacagacataattcctcggtttggccttcccacctctatacagtctgataatggatcggcctttactagtcaaatcacccaagcagtttctcaggctcttggtattcagtggaaccttcatatcccttaccgtcctccatcttcaggaaaggtagaacagactaatgttgttttaaagacacacctcaccaagctcagcctccaacttcaaaaggattaggcagtacttttacctcttgcccttcttagaattagagcctgtcctcgagatgctacagggtacggtccatttgaacatttatatggatgcactttcttgctcagccccaacctcatcccagacaccagccctctaggcaactatcttccagtcctccaggaggctagacaggaaattcaccaggctgctaatctcttgcctactccagattcccagcaatatgaagacaccctagctggacgatcagttcttgttaagaatctgacccctcaaactctactacctcgaaggaccggaccctacttagtcatctgtagtaccccaactgccgtctgcctgcaggatcctccccactgggtttaccattccagaataaagctgtgtccatcggacagccagcctaatccctcctcttcctcctggaagtcgcaagcactctcccctacttcccttaaactcactcgtatttctgaagaacagtagtaacccttatgagcctaacacatcccttcattctattaggtctgttcatccttaccctactttttgcaacagggctttacaaagtcacccccactactaggaccgagccccaaaaactagtcatccctactatcttctgtctagtcatactcctattctccattcttaactacttataaatgccctactcttgtttacactgctggtttacactgtttcttcaagccatcacagctgatatttcttagtgctatccccaaaacaccactcttaactctctcttagagcagatagatgatctttgctggcaggggactctccaatactttcaccctgatgaagttctattctttacttttatactgactcttttcgtcattcccattcttatgccaccctctacctctccccagctctctccaccacactatcaaccttacccattctctcctagctgtttctaatccctcctcatcgaacaactgctagctttgcatttccctttcttccagcgtctacacagctgtccccgccttacatgcagactgggcaacatctcctgtctccttacacctccgaacttcctttaacagccctcacctttaccctcctgaagaactcatttactttctagacaggtgcagcaagacctccccagacatttcacatcagcaagctgctgacctcctccacacttacttaaaaaacctttctccttatatcaactctactccccctatatttggacctctcacaacacaaactactattcctatggccgctcctttatgtgtctctcggcaaagacacactggaattcccctaggtaacctttcaccttcttgatgttcctttactcttcatctccagagcccaactacacacatcactaaaactgttggagccttccagctccatattacagacaagccctctatcaatactggcaaacttaaaaacattagcagtaattattgcttaggaagacacttaccctgtatttcactccatccttagctaccttccgcttgctcgtcagactctcctcccaggccctcttcttgtttacttatacccagccccaaaaataacagtgaaaggttgctcgtagatactcaacattttctcatacaccatgaaaatcaaaccttcccctctatgcagttaccccatcagtccccattacaacctctgacggctgccgccctagctggatccctaggagtctgggtacaagacatccctttcagcactccttctcatctttttactttgcaactccagttttgcctcgcacaaggtctcttcttcctctgtggatcctctacctacatgtgtctacctgttgattggacaggcacatgcacactagttttccttgctcccaaaattcaatttgcaaatgggaccgaagagctccctgttcccctcatgacactgacatgacaaaaaagagttattccattaattcccttgcttgtcggtttaggactttctgcctccactattgctctcagtactggaatagcaggcatttcaacctctgtcatgaccttctgtagcctctctaatgacttctctgctagcatcacagacatatcgcaaactttatcagtccctacaggcccaagttgactctttagctacagttgtcctccaaaaccgctgaggccttgatttactcactgctgaaaaaggaggactctgtatattcttaaatgaagagtgttgtttttacctaaatcaatccagcctggtgtatgacaacataaaaaaactcaaggatagagcccaaaaacttgccaaccaagcaagtaattacactgaacctcattgggcactctgtaattggatgtcctgggtcctcccaattcttagtcctttaatacctatttttctccttttattcagaccttgtatcttctgtttagtttctcaattcatccaaaaccgtatccggggcatcaccaatcattctatacgacaaatgtttcttctaacaaccccacaatatcaccccttaccacaaaatcttccttcagcttaatctctcccactctaggttcccacggcgcccctaatcctgctcgaagcagccctgagaaacaccgcccattatctctccatgccaccccctcaaaaaaaatttctttctgctgccccaacacttcaatactattttatgttatttttcttattaatataagaaggcaggaatgtcaggcctctgagcccaagctaagccatcgcatcccctgtgacctgcatgtgtatgcccagatggcgtgaagtaactgaagaatcacaaaagaagtgaaaatggcctgttcctgccttaactgacattccaccacaaaagaaatgaaaatggctggtccttgccttaagtgatgacattaccttgtgaaattccttttcctggctcatcctggctcaaaaaagctcccccactgagtaccttgtgaccccccactcctgcccaccagagaacaaccccactttgactgtaattttcctttacctacccaaatcttataaaatggccccaccccatctcccttcactgactctcttttcggactcagcctgcatgcagccaggtgattaaaaagctttattgctcacacaaagcctatttggtggtctcttcatgcgaacgcgagtgaaa

SEQ ID NO: 431 - DNA, 782 bp, Homo sapiens
gagagacaggactagctggatttcctgtgctgactaagaattcctaagcctagctggggaaggtgaccccatccacctttaaagacggggcttataactcagctcatacccgaccaatcaggtagtaaagagagctcactaaaatatcaattaggctaaaagcaggaggtaaagaaatagtcaatcatctatcgcctgagagcacaggggagggataatgatcgggatataaacccaggcattcgagccagcagtggcaacccactttaggtcccctcccattgtatgggagctctgttttcactctattaaatcttgcaactgcacacgcttctggtccatgtttgttccagctccagctgagcttttgctcactatccaccactgttgaccgctgccatcgcagacccactgctgacttccatgcctctggatctggcagggtgtctgctgtgcttctgatccagggagacacccattgccgctgccaatcgggctagaggctcgccattgttcctgagcggctaagtgcctgggttcctcctaatcgagctgaacacaagttgctgggttccacggttctctcccatgacccacggcttctaatagagcaataacactcactgtgtggcccaaggttccattccttggaatctgtgaggccaagaaccccaagtcagagaacaaaaggcttgctgccatcttgggagtggcccgccaccatcttgggagtggcctgccaccatcttgggagctctaagaacaaagacctgcccgtagca

SEQ ID NO: 432 - DNA, 736 bp, Homo sapiens
gtcaggcctctgagcccaagcctgcacgtatacacccagatggcctgaagcaactgaagaatcacagaagaagtgaaaatggccagttcctgccttaactgatgacattccaccattgtgatttgttcctgccccaccttaactgattgattaccttggtgaaattccttctcctcgacaataagtctcagaagctcccccaccgagcaccttgtgacccctgcccctgcccgcaagagaaaaaccccctttgactgtaattttccactactcacccaaatcctgtaaaactgccccacccctatcttccttgctggctctcttttcagcctcagcccacctgcacccaggtgattaaaaagctttattgcggccaggtgcggtggctcacgcctgtaatcctagcactgtgggaggccgaggcaggtggatcacaaggtcaggagaccgacaccatcctgtctaacactatgaaaacctgtctctaataaaaatataaaaaattagccaggcatggtccctgtagtcccaggtactcgggagactgaggcaggagagtggtgtgaacccgggaggtggagcttgcagcaagccgagatcacaccactgcactccagcttgggcgaaagagtgagactccatctcaaaataaataaataaataaataataaaataaaataaagctttattgctcacacaaagcctgttggtggtctcttcacatggacgcgtgtga

SEQ ID NO: 433 - DNA, 5669 bp, Homo sapiens
gtcaggcctctgagcctaagctaagccatcacatcccctgtgacctgcatgtatgcatccagatggccagttcctgccttaactgatgacattcctccacaaaagaagtgaaaatggcctgttcctgccttaactgatgacaattaccttgtgaaattccttctcctggctcatcctggctcaaaaactcccccgctgagcaccttgtgacccccacccctgcctgccagagaacaacccccctttttcctttacctacccaaatcttataaaacggccccaccccatctccctttgctgactctctttttggactcggcccgcctgcacccaggtgaaataagcagtcttgttgctcacagaaagcctgttggtggtctcttcacacagacacgagtgaaatttggtgctgtgactctgatcgggggacctcccttgggagatcaatcccctgtcctcctgctctttgttccatgagaaagatccacctacgacctctggtcctcagaccaaccagcccaaggaacatctcaccatttttaaatctggtaagcagccttttttactctcttctccaacctctgttactatcccacaacctctttctcctttgaatcttggcaccatacttcagtctctcccttctcttaatttcagttcctttccttttctggtagagacgaaggagacatgttttatctgtggacccaaaactccggcgccagtctcggactcgggaagacagtcttcccttggtgtttaatcatgcggggacacctgcctgattattcacccacgtttcagaggtgtctgaccacgtggggatgcctgccttggtcctgtcaccctcagcggcaagtactgcttttctggggggaaggaaacccccgatcccttctctccatgtctctaccccttctccagtttcctggggggcaagcatcccccatcccttctctctgtgtctctaccctcttttctctggacttgcttccttcactataggcaaccttccaccctccattcctccttctcccttagcctgtgttctcaaagacttaacacctcttcaactcacacctgacctaaaatctaaacaccttttcttctgcaatgccgcttgaccccaatacaaactcgacagtggttccaaatagccagaaaatggcactttcaatttttccatcctacaagatctaaataattcttgtcgtaaaataggcaaacagtctgaggtgcctgacgtccaggcattctttcacacactgttccctccctagtctctgtttccaatgtgactcatcccaaatcctccttctttgcctctcgcctgttccctcagtcccaaccccaagcatcactgggtctttctaatcttccttttctacagacccatctgacctctcccctcctccccaggctgctccttgccaggctgagctaggtccaattcttcctcagcctcccctcctcacacctggtcctgcttacagtttcgttctgtgaccagccctccctgacctgcccaagaatttcctcttaaaaaggtggctggagctaaaggcacagtcgaggttaatactcctttttctttatccgacctctcccaaatcagttagcatttaggctctttttcatcaaatatgaaaaacccagcccagttcatggctcgtttggtagcaaccctgagacactttacagccctagaccctaaaaagtcaaaaggccaccttattctcaatatacattacccaatctgctcccaactttaaataaagctccaaaaattaaattctggccctcaaaccccacaacaggacttaattaacctcgccttcaaggtgtacaataatagaaaaattttgcaattccttgcctccactgtgaaacaaaccccagccacatctccagcacacaagaacttccaaacacctcaaccgcagcggccagacgttcctccagaacctcctcccccaggagcttgctacaagtgccagaaatctggccactgggccaaggaatgcctgcagtccaggattcctcctaagccatgtcccatctatgcgggaccccactgaaaattggactgttcaactcacctggcagccactcccagagtccctggaactgtggcccagtgctctctgactgactccttcccagatcttctcagtttagcggctgaagactgatgctgcccgatcgcctcagaagccccctagaccatcatggatgccgagcttcaggtaactctcacagtggaaggtaagtctgtccccttcttaatcaatacggaggctacccactacacattaccttcttttcaagggcctgtttcccttgcctccataactgttgtaggtattgatggccaggcttctaaacctcttaaaactccccaactctggtgccaacttagacaatactcctttaagcactccttttagttatccccacctgccagttcccttattaggccgagacattttaactaaattatctgcttccctaactattcctaggctacagccacacctcattgccaacttttcccccagttcaaagcctccttcacttcctcctctcatatcccccaccttaacctacaagtataagatacctgtactccctccttggtgaccgatcatgcatcccttaccatctcattaaaacctaatcacccttaccccactcaatgccaatatcccatcccacagcatgctttaaaaggattaaagcctgttatcactccctgttacagcatggcctcttaaagcctataaactctccttacaattcccccattttacctgtcctagaaccagacaagccttacaggttagttcaggatctgcacctttccaaccaaattgttttgcctatccactccatggtgccaaacccatatactctcctatcctcaacacctccctccacaacccattattctcttctggatctcaaacatgctttctttactatccctttgcacccttcatcccagcctctctttgctttcacttagactgaccctgacacccatcaggctcagcaaattacctgggctgtactgccacaagccttcacagatagcccccattacctcagtcaagcccaaatatcatcctcatctgttacctatctcggcataattctcataaaaacaaacgtgctctccctgctgatcgtgtctgactgatctcccaaacctcaatcacttctacaaaacaacaactcctttccttcctaggcatggttagtgcagtcagaattcatacacaagagccgggactgcaccctgtagcctttctgtccaaacaacttaaccttactgttttagcgtagccctcatgtctgtgtgcagcggctaccactgccttaatacttttagaggccctcagaatcacaaaatgtgttcaactcactctctaccgttctcataacttccaaaatctattttcttactcacacctgatgcttatactttctgctgccctccactacctctcagcaagccgaactcactgccttaacttgagccctcactcttgcaaaaggactacgcgtcaatatttgtactgactctaaatatgccttctatatcttgcaccaccatgctgttatatgggctgaaagagatttcctccctacgcaagggtcctccatcattaatgcctctttaataaaacgcttctcaaagccgctttacttccaaaggaagctggagtcattcactgcaaaggccatcaaaaggcatcagatcccactgctcaggacaatgcttatgctgataagatagctaaaaaagcagctagcgttccaaattacatccctcactttcagtttttctccttctcatctggccactcccacctgctcccctgctgaaacttccacctatcaatctcttcccacacaaggcaaacggttcttagaccaaggaaaataactccttccagcctcacaggcccattctattctgtcatcatttcataacctcttccatgtaggttacaagccactagcctgcctgttagaacctctcatttcctttccatcgtagaaatctatcctcaaggaaatcacttctcagtgttccatctgctattctactactcctcaggaatttctcaggccccctcccttccctacacatcaagctcggggatttgcccctgcccaggactggcaaattgactttactcacgtgcctcaagtcagaaaactaaaatacctcttggtctgggtagatactttcactggataggtagagacctttcctacagggtctgagaaggccaccatggtcatttcttcccttctgtcagacataattcctcggtttggccttcccacctctatacggtctgatagcagaccggcctttattagtcaaatcacccaaccagctttttaggctcttggtattcagtgaaacctttatatcccttaccgtcctcagtcttcaggagaggtagaatggactaatggtctgttaaaaacacacctcaccaagctcagccaccaacttaaaaaggactggacaatacttttaccacttgtcgttctcagaattcaggcctgtcctcagaatgctacagggtacagcccatttgagctcctgcatagacgctcctttttattaggtcccagtctcattccagacaccagaacaacttggactgcaccccaaaaaacttgtcatgacaaatatgactatcttctgtctagtcatactcctattcaccattctcaactattcctaaatgccccgctcttgtttacactgtcagtaaactgtttctgcaatccatcacagctggtatctcctggtgctagccccaaaccgccactcttaactccctcttaaagtaaataaataatctttgctggcagggctatgctgaacctccttaggcactctctaattggatgtcctatatcctcccaattcttagtcctttaatacctgtttttctccttgtcttattccttttagtttttcaattcatacaaaaccatatccaggccatcaccaataattctatacgacaaatgtttcttctaaccatcccacaatatcaccccttaccgcaaaatcttccttcagcttaatgtctcccactctaggttcccacgccgcccctaatcccgctcgaagctgccctgagaaacatcgcccattgtctctccataccaccccccaaaattttcgctgctccaacactttaccactttttcattttatttttcttattgatataagaagacaggaatgtcaggcctctgagcccaagctaagccatcatatcccctgtgacctgcatgtacacatccagatggctggttcctgccttaactgatgacattccaccacaaaagaagtgaaaatggcctgttcctgacttaactgatgacattacctcgtaaaattccttctcctggctcataagctccctcactgagcaccttgtgacccccacccctccctgccagagaacaatccccctttttcctttacctacccaaatcttatacaacggccccaccccgatctcccttcgctgactctctttttggattcagcccgctgcacacaggtgaaataaacagccttgttgctcacacaaagcctgtctggtggtctcttcacatggacgcgagtgaaa

SEQ ID NO: 434 - DNA, 775 bp, Homo sapiens
gagagacaggactagctggatttcctaggcagactaagaatccctaagcctagctgggaaggtgaccacgtccacctttaaagatggggcttgcaacttagctcacacccgagccatcagagagctcactaaaatgctaattaggcaaaaacaggaggtaaagaaatagctaatcatctatcgcctaagagcacagcgggagggacaatgatcgggatataaacccaggcattccagccggcaacggctaccctctttgggtcccctccctttgtatgggagctctgtcttcactctattaaatcttgcaactgcactttcttttggtctgtgtttgttacggctcgagctgagctttcgctcgccgtccaccactgctgtttgccactgttacagacctgtggctgacttccacagggtggatccagcagggtgtctgctgtactcctgatccagctaggcgcccactgctgctcccgatagggctacaggcttgccatcgttcctgcatggctaagtgcccgggttcgtcctaatcgagctgaacactagtcagtcactgggttccacagttctcttccgtgacccacggcttctaatagagctataacactcaccgcatggcccaagattccattccttggaatccgtgaggccaagaaccccaggtcagagaacatgaggcttgccaccatcttggaagtggcccgccgccattttggaagtggcctgccaccatcttgggagctctgggagcaaggacgacccggtaaca

SEQ ID NO: 435 - DNA, 5648 bp, Homo sapiens
caggcctctgagcccaagctaagccatcatatcccctgtgacctgcacatacacatccagatggctggttcctgccttagctgatgacattccaccacagaagaagtgaaaatggcctgttcctgccttaactgatgacattatcttgtgaaattccttctcctggctcatcctggctcaaaagctcccctactgagcaccttgtgacccccactcctgcccatcagagaacaacccctttgactgtaattttcctttacctatccaaatcctataaaacggccccacccctatatctcccttttctgactctcttttcagactcagtccgcctgcacccaggtgaaataaacagccttgttgctcaaacaaagcctgtttggtggtctcttcacatggatgcacatgaaatttggtgccgtgtctcggatcgggggacatcccttgggagatcaatcccctgtcctcctgctttttgctccgtgagaaagatccacctacaacctcaggtcctcagaccgaccagtccaaggaacatctcaccaacttcaaatccagtaagtggcctctttttactctcttttccaacctctctcactatccctcaacctctttctcctttcaactgccacacttcaatctctcccttctcttaatttcaattcctttcattttctcgtagagacaaaggagacacattttatccgtggacccaaaactccggcaccagtcatgtactcagaagacagccttcccttagtgtttaatcattgtggggatgcctctctgattattcacccacattccattggtgtctgatctccgcagggatgcctgacttgatctttcacccatgttcccttggtggcaagtcaattgcggggacacctgctttggctgctcacccacgttgcagcccagggctgctccccacccccttctccatgtctctaccctcttctttaaacttgcctccttcactatgggcaaccttccaccctccattcctccttcttctcccttaacctgtgttcttaaaaacctaaaacctcttcaactcacacctgacctaaaacctaaatgccttattttcttttgcaatcctgcctgaccccagtacaaactcaacagtggttccaaatagccataaaatggcactttcaatttttccatcctacaagatctaaataattcttgtcgtaaaatgggcaaacggtctgaggtgcctgatgtccaggcattctttacacattggtccctccttagtctctgtgcccagtgcaactcctcccaaatcttccttctttccctcccacctgtcccctcagccccaaccccaagcgttgctgagtctttctaatcttccttttctacagacccatctgacctctcccctcctcaccaggccaagctaggtgccaattcttcctcagcctcccctcttccaccctataattcttttatcacctcccttcctcacacccagtccaccttacagttttgttctgtgactagccctcccccacctgcccagcaatttactcttaaaaaggtggctggagctaaaggcatagtcaaggttaatgctcctttttctttatcccaaaacagcgtttagactctttttcatcaaatgtaaaaacccagcccagttcatggctcatttggcagcaaccctgagatgctttacagccctagaccctaaaaggtcaaaaggccatcttattctcaatatacattacccaatctgctctcgacattaaataaaactccaaaaattaaattctggccctcaaaccccacaacaggacttaattaacctcaccttcaaggtgtacaataatagagtagaggcagccaagtagcagcgtatttttgagttgcaattccttgcctccactatgagacaaaccccagccacatctccggcacacaagaacttccaaacgcctaaaccgcagtggccaggcattcctccaggcctgcctcccctaggagcttgctacaagtgctagaaatctggccatcaggccaaggaatgcccgcagcctgggattcctcctaagccatgtcccatctgtacgggaccacactgaaaatcagactgttcaactcacctggcagccactcccagagcccctggaactctggcctaaggctttctgactgactccttcccagatcttctcagcttagcagctgaagactgacactgcccgatagccttggaagccccctagaccatcacggatgccgagctttaagtaactctcacagtggaaggtaagtccatccccttcttaatcaatacgaaggctacccacaccacatctccacattaccttcttttcaaaggactgtttcccttgcctccataactgttgtgggtattgatggccaggcttctaaacctcttaaagctccctaactctggtgccaagttagaaaatactcttttaagcactcctttttagttatcccagttcctttattaggccaagacactttaactaaattatccacttccctgagtattcctggactacagccacatctcattgccacccttcttcccaatccaaagcctcccttgtgtcctcccttttttatccccccaccttaacccacaaggataagatacctctactccctccttggcgactgatcacgcatcccttaccatctcattaaaacctaatcacccttaccctgctcaatgccaatctcccatcccacagcatgctttcaaaggattaaagcctgttatcactggcctgttacagcatgaccttttaaagcctataaattcttcttacaattcccccattttacccgtcctagaaccagacaagccttacaggttagttcaggatctgcaccttatcaacacaattgttttgcctattcaccccatggtgccaaacccatatactctcctatcctcaatacctccctccacaacccattattctgttctggatctcaaacatgctttctttactattcctttgcacccttcatcccagcctctctttgctttcacttggactgaccctgacacccatcagtctcagcaaattacctgggctgtactgccacaaagcttcacagacagcccccattacttcagtcaagccaaaatttcatcctcatctgttacctatctcagcataattctcagaaaaacacacgtgctctccctgccgatcatgtccagctgatccctcaaaccacaacaccttctgcaaaacaacaactcctttccttcctaggcatggttggatacttttgacttcagatacctggttttgccatcctaacaaaaccattatataaactcacaaaaagaaacctagctgacccaatagatcctaaatcctttccccactcctctttccattccttgaagacagttttagagactgcccccaccctagctctccctgactcatcccaactcttttcattatccacagccgaagtgcagggctgtgcagtcggaattcttacacaagaactgggaccgcaccccgtagcctttttatccaaacaacttgaccttactgtcttgcttagccctcaagtctgtgtgcagcaggtgccaccacaaccccaatacttttagaggcccttaaaatcacaaactatgctcaacttactctctgcagttctcataacttccaaaatctattttcttcctcactcctgacacatatactttctgctccctggctccttcagctgttctcactctttggtgagtctcccacaattaccattgttcctggcccagacttcagtctggtctcccacattattcctgataccacaactgacccccatgactgtatctctctgatccacctgacattcaccccatttccccatatttccttctttcctgttcctcaccctgatcacactttgtttattgatggcaattccagcaggcctaatggccacacaccagcaaaagcaggctatgctatggtacaagccactagcccgcctcttagaacctctcatttcctttccatcgtggaaatctatccgcaaggaaataacttctcagtgttccatctgctattctactactcctcagggattattcaggccccctcccttccctacacatcaagcttggagatttgcccccacccagcactggtaaattggctttactcagcatgccccaagtcagataactaaaatacctcttagtctaagcagacactttcgctggataagtagaggcctttcctacagggtctgagaaggccaccacagtcatttcttcccttctgtcagacataattcctcggtttgggcttcccatctctatacagtctgataacggaccagcctttattagtcaaatcagccaagcagtttttcaggctcttggtgttcattgaaacctttatatcccttacggtcctccgtcttcagaaaaagtagaacagactagaggtcttttaaaaacacacctcacgaagctcagccaccaacttaaaaaggactggacagtacttttaccactttcccttctcacaagtcaggcctgtcctcagagtgctacaaggtacagcccattcgagctcctgtatagatgctcctttttattaggccccagtctcatcccagacaccagaccaacttagactgcaccccaaaaaacttgtaatccctactattttctatctagtcatactcctattcactgttctcaactactcataaatgccctgctcttgtttacactgctggtttacactgtttctccaagctatcacagctgatatctcctggtgctatccccaaaccaccactcttaactcttagagtaaataaataatctttgctggcaaggctatgctgaacctccttaggcactctctaattagatgtcctaggtcctcccaattcttagtcctttaatacctgtttttctccttctcttattccgtttagtttttcaattcatacaaaaccgtatccaggccatcactaataattctacatgacaaatgtttcttttaacaaccccgcaatattgccctttaccacaaaatcttccttcagcttaatctctcccactctaggttcccatgccgcccctaatcctgctcaaagcagccctgagaaacatcacccattatctctccataccacccgcaaaaattttcactgtcccaacactttaccactatttcattttatttttcttattaatataagacaggaatgtcaggactctgagtccaagctaagcctgtgacctgcacgtacacatccagatggctggttcctgccttaactgatgacattccaccacaaaagaagtgaaaatggcctgttcctgccttaactgatgacattctcttgtgaaattccttctcctggctcattctggctcaaaagctcccctgctgagcaccttgtgacccccactcctgcccgccagagaataacccccctttgactgtaattttcctttacctacccaaatcctataaaatggccccacctctatctcccttctctgactctcttttcggactcagcccgcctgcacccaggtgaaataaacagccttgttgctcacagaaggcctgtttggtggtctcttcacacagacgtgcacgaaa

SEQ ID NO: 436 - DNA, 925 bp, Homo sapiens
gtggggaaaagaaagatcagattgttactgtgtctgtgtagaaagaagtagacataggggactccattttgttctgtaatctataaccttacccccaaccctgtgctccctgaaacatgtggtgtgtcaactcaggattaaatggattaagggctgtgcaagatgtgctttgttaaacaaatgcttgaaggcagcaagctcgttaagagtcatcaccactccctaatctcaagtacccagggaaagaaagcactgcagaaggctgcagggacctctgcctaggaaagccaggtattgtccaaggtttctccccatgtgatagtctgaaatatggcctcgtgggaagggaaagacctgacctttccccagcccaacacccgtaaagggtctgtgctgaggaggattagtaaaagaggaaggaacgcctctttgcagttgagacaggaggaaggtatctgtctcctgcccgtccctgggcaatggaatgtctcgatataaaacccgattgtatattccacctactgagataggggaaaaccgccttagggcggaggtggaacatgcgggcagcaatactgctctttaaggcattgagatgtttatgtgtatacatatctaaagcacagcacttaattctttaccttgtttatgatgcagagaactttgttcatgtgtttatctgctgaccctctctccactattatcctatgatcctgccacatccccctctccgaggaacacccaataatgatcaataaatactaagggaactcagaggctggcgtggatcctctgtgtgctgaacgccggtctcctgggcccttttttctttctctatactttgtctctgtgtctctttcttttccaagtctctcgttccacctaacgagaaaaacccacaggtgtggaggggcaacccacctct

SEQ ID NO: 437 - DNA, 381 bp, Homo sapiens
gtcagacctctgagcccaagctaagccatcatatcccctgtgacctgtgcagatggctggttcctgccttaactgatgacattccaccaccaaagaagtgaaaatggcctgttcctgcctcaactaatgacattatcttgtgaaattccttctcctggctcatcctggctcaaaagcttccctactgagcaccttgtgacccccactcctgcccgccagagaaccacccccctttttcctttacctaaccaaatcctgtaaaacagccccaccccgtatctcccttcgctgactctctttttggactcagcccgcctgcaaacagctttattgctcacacaaagcctgtttggtggtctcttcacacggacgtgagtgaaa

SEQ ID NO: 438 - DNA, 905 bp, Homo sapiens
gtggggaaaagaaagagagatcagattgttactgtgtctgtgtagaaagaagtagacataggagactccattttgttccctactaagaaaaattcttctgccctgagatgctgccaatctgtaacccttcccccaaccctgtgctccccgaaacatgcgctgtgtcaactcagggccaaatggatcaagggctgtgcagggtgtgctttgttaaacaaatgcttgaaggcagcatgcttgttaagagtcatcaccactccccaatctcaaaccactccccaatctcaagtacccagagacacaaaacactgcagaaggccgcagggacctctgcccaggaaagccaggcaccgtccaaggtttctccccatgtgagagtctgaaatatggccttgtgggaagggaaagacctgaccgtcccccagcccgacacccgacacccgtaaaaggtctgtgctgaggaggattagtaaaagaggaaggaacgcctttttgcagttgagataagaggaaggcttctgtctcctgctcatccctgggcaatggaatgtctgggtgtaaagctgattgtatattccatctactgagataggagaaaaccgccttagggctggaggtgggacatgctggcagcaatactgttccttaaggcaatgagatgtttatgtatatgcacatcaaaagcacagcacttttttctttaccttgtttatggtgcagagacatttgttcacgtgtttaccttctgacctccccaccattatcctattatcctgtcacgcccgataatgagcaataaatactaagggaacgcagcagccggggctggcgtggatcctccatatgctgaatgcctgtcccctgggcccctttttcttttttttttttttttttttttttttatt

SEQ ID NO: 439 - DNA, 1137 bp, Homo sapiens
accccatgcacccaagtcttagcaggcatgattatagccaccagccacctgggcatgtgggcagcctcaggattttttggagctgtactcaaccccttattttattttgcctctcaccttcagaccatcaagctccagatgatcctcagtgagggatgccatactctcaatattcaagagtcactcttctacagagaattcctaggctgcccatcagaggaacatgacaaaggtgaaatcctgcccctgtctctcttggacctggatggataccacttccatcaacccatagagccaccctgccctgacatctagcaagaggccaagacccgcaaaacaaccaccactatccctctatcaccaggaagcaactacaaaaaagtgatccttatccattttccccaaagaactggggtcttggactcttgaagagggaaatgttacagtaggtaggtagtcagacataagcagggcaagagagtcctctccccaccaggaatgtcaggtgatcatcaggtgatagtcaggtgattgttaaactgtttctctagaataacaattggttgcagctggagccagggaaaggcagtttcccaatagacagaaaatacatgaagctggtgatcggcagcttctgataagatctcaggagttggacaagtggactcaagcatgcacactaaaaggcaaaattgcagagttaatctgatatatgaccttcctgtaggaacactcaacttgtaaaggaagaacgcctcaagtgagcatgcacacaagttcattaaaagcactgtgcatgtggtccctcccaagtgctggcaggccagactgcccaggccagaggaagaatcaggggagaaaagatgcgaccccctggaagcatgccaatgtataaaaccccaagtcaaaggtcaaaccacgcacttgaatctctcaagttgcctgtgtggccctcttacaagtgtactttatttcctattgttcttgctctaacaccctttaataaactttcacttctgctttaaaacttgccttggtctcttactttgctttatgcccctcagttgaattctttcttctgaggaggcaagaattgaggttgctgcaggcccgtacagattcactgctgctaacata

SEQ ID NO: 440 - DNA, 662 bp, Homo sapiens
ttacagtaggtaactagtcagacatgagcagggcaggagaaagctcccactactcccacacacaccaaaaatgttacaccactatcacgtgatgatcaggaagttgttagctgtctctctaaaataataattgatcacagctggtgccagggaaaggcagactcccaatagatagaaacactgaatctggtgatcagcagcttcccaacaagatctcaggagttgggtgagtgggctgaagcatgtgcattaagaggcaaatggtagagtttaactggtatatgactttctaggatccttctatcggaaagagaagaacaccttaagtgagcatgcatccaactccaataaacacactgcacatgctcatttcccaagtgctagcaggtcactgcacatgtggacagcccaacccaagagaagaatcagtggagaagggacacaagaccccagaagaatgccaacgtacaaaactccaagtcaaaaggtcaaaccacacacctgatctccgaagttgcccagttggcctgcttcttacttcctttcattcctgctttaaaacttgcctcggtctctccttctgccttatgcccctcagtcaaattctttcttctgaggaggtgaaaattgaggctgctgctggcccatatggatttgccagt

SEQ ID NO: 441 - DNA, 377 bp, Homo sapiens
gtcaggcctctgagcccaaacctgcacctattcatccagatagcctgaagtaactgaagaatcacaaaaacaagtgaaaatggcctgttcctgccttaactgatgacattaccttgtgaaattccttctcctggctcattctggctcaaaagctccctcactgcgcaccttgtgacccccacccctgccagtcagagaacaaccccctttgactgtaattttccactacctacccaaatcctataaaacggctccacccctatctccctttgctgattctattttcagactcagcccgcctgcacccaggtgattaaaaagctttattgatcacacaaagcctgtttggtggtctcttcccacagacgtgagtgaaa

SEQ ID NO: 442 - DNA, 440 bp, Homo sapiens
ccaggccatcgcatcccaggccaggccatcgcatcccctgtgacttgcaggtatacatccagatggcctaaagtaactgaagatccacaaaagaagtaaaaacagccttaactgatgacattccaccattgtgatttgttcctgccccaccctaactgatcaatgtactttgtaatcttccccacccttaagaaggttatttgtaattctccccacccttgagaatgtactttgtgagattcacccctgcccaccagagaacaaccccctttgactgtaattttccattaccttcccaaatcctataaaacggccccacccctatctcccttcgctgactctcttttcggactcagcccgcctgcacccaggtgaaatacacagccatgttgctcacacaaagcctgtttggtggtctcttcacatggacgcacatgaaa

SEQ ID NO: 443 - DNA, 5892 bp, Homo sapiens
gtcaggcctctgagcccaagccaagccatcgcatcccctgtgacttgcacgtatatgcctagatggcctgaagtaactgaagaatcacaaaagaagtgaatatgccctgccccaccttaactgatgacattccaccacaaaagaagtgtaaatggccggtccttgccttaactgatgacattaccttgtgtgcgacccccactcctgcctgccagagaacaaaccccctttgactgtaattttcctttacctacccaaatcctataaaacggccccacccttatctccctttgctgactctcttttcggactcagcccacctgcacccaggtgaaataaacaaccatgttgctcacacaaggcctgtttggtggtctcttcacacggacgtgcatgaaatttggtgccgtgactcggatcgggggacctcccttgggagatcaatcccctgtcctcctgttctttgctccgtgagaaagatccacctacgacctcaggtcctcagaccgaccagcccaagaaacatctcaccaatttcaaatccggtaagcggcctctttttactctcttctccaacctccctcactatccctcaacctctttctcctttcaatcttggcgccacaattcaatctctcccttctcttaatttcaattcctttcattttctggtagagacaaaggagacacgttttatccgtggacccaaaactctggcgccagtcacggactgggaaggcagccttcccttggtgtttaatcattgcagggctgcctctctgattattcacccacgtttcaaaggtgtcagaccacgcagggacgcctgccttagtccttcacccttagtggcaagtcccgctttcctggggcaggggcaagtaccccaaccccttctctccgtgtctctaccccttctctgcttttctggaagaggggcaagtaccactcaaccccttctccttcacccttagcggcaagtcccgcttttctacggggcaagaacccccaatcccttatttctgcaccccaacctcttatctctgtgccccaatcccttatttacgcaccccaacctcgtatctctgtgccccaatcccttatttccgtgccccaacctcttatatctctgcaccccaatcccttatttctgcaccccaacctcttttatctctgtgccccaatcccttatttccatgccccgacctcttatttctgcgccccatcccttatttccatgccctgacctcttatctctgcgccccaacctcttatctctgtgccccaaccccttttcccacttttctggaaggtaagaacccccgaaccccttccctccatttctctactctctcttttctctaggcttgcttccttcactatgggcaaccttccaccctccattcctccttctactcccttggcctgtgttctcaaaaacttaaaacctcttcaacttacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacatccaggcattcttttacacatcagtcccttcctagtctctgtgcccagtgcaacttgtcccaaatcttccttctttccctcccgcctgtcccctcagtattaaccccaagcgtcgctgagtctttctaatcttccttttctacagacccatctgacctctcccttcctccccaggctgctcttcgccaggccgagctaggtcccaattcttcctcagcctctgctcctccaccctatataatctttttatcacctcccctcctcacacctggtccggcttacagtttcgttccgtgactagccctccccatcctgcccagcaatttactcttaaaaaggtggctggagctaaaggcatagtcaaggttaatgctcctttttctttatcccaaatcagatagcgtttaggctctttttcatcaaatataaaaatccagcccagttcatgactcgtttggcagcaaccctgagacactttacagccctagaccctaaaaggtcaaaaggccgtcttattctcaaaatacattttattacccaatctgctaccgacattaaataaaactccaaaaattaaattccggccctgaaaccccacaacaggatttaattaacctcgccttcaaggtgtacaataatagaaaaaagttgcaattccttgcctccactgtgagacaaaccccagccacatctccagcacataagaacttccaaacgcctgaaccgcagcggccaggcgttcctccagaacctcctcccacaggagcttgctacacgtgccggaaatctggccactgggccaaggaatgcccgcagcctgggattcctcctaagctacgtcccatctgtgtgggaccccactgaaaatcggactgttcaactcacctagcagccactcccagagcccctggaactctagcccaaggctctctgactgactccttcccagatcttctcggcttagcggctgaagactgacactgcccgatcgcctcagaagccccctagaccatcacggatgctgagcttcgggtaactctcacagtggaaggtaagcccgtccccttcttaatcaattcggaggctacccactctacattaccttcttttcaagggcctgtttcccttgcctccataactgttgtgggtattgacagccaggcttctaaacctcttaaaactccccaactctggtgccaacttagacaacactcttttaagcactcctttttagttatccccacctgcccagttcccttattaggctgagacactttaactaaattatctgcttccctgactattcctggactacagcaatatctcattgccgcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccagtatcccatcccgcagcacgctttaaaaggattagagcctgttatcactcacctgctacagcatggccttttaaagactataaactctccttacaatacccccattttacctgtcctaaaaccagacaagcctttacaagttagttcaggatctgcgccttatcaaccaaattgttttgcctatccaccccgtggtgccaaacccatatactctcctatcctcaatacctgcctctacaacccattagtctgttctagatctcaaacatgctttctttactattcctttgcacccttcatcccagcctctcttcgctttcacttggactgaccctgacactcatcaagctcagcaaattacctaggctgtactgccgcaaagcttcacagacagcccccgttacttcaatcaagcccaaatttcttcctcatctgttacctatctcggcataattctcataaaaacacacgtgctctccctgccaatcgtgtccaactgatctctcaaacccaagcaccttctacaaaacaactcctttccttcctaggcatggttagcgcggtcagaattcttacacaagagccaggaccacaccctgtagcctttctggccaaacaacttgaccttactgttttagcctagccctcgtgtctgcgtgcagtggctgctgctgctttaatacttttagaggccctcaaaatcacaaactatgctcaactcactctctacagttctcataacttccaaaatgtattgtcttcctcatacctgacgcatatactttctgctccccggctccttcagctgtactcactctttgttgagtctcccacaattaccattgttcctggctcggacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctgctactcctcagggattattcaggcaccctcccttccctacacatcaagctcgaggatttgccccacctagtactggtaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagacgagcctttattagtcaaatcagccaagcagtttttcaggctcttagtattcagtgaaacctttatatcccttatggtcctccgtcttcaagaaaagtagaatggactaaagtaaaggtcttttaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccaacttagactgtgccccccaccaaaaaaaaacttgtcatccctactattttctgtctagtcatactcctattcaccgttctcaactactcatacatgccctgctcttgtttacactgccggtttacactgtttttccaaggcatcacagctgatatctcctggtgctatccccaaactgccactctaaactcttgaagtaaataaataatctttgctggcaggactatgccgaatctccttaagcactctctaatcagatatcctgagtcatcccaattcttagaccttttatacctgtttttctccttctgttattccatttagcttttcaattcatacaaaaccgtatccaggccatcaccaatcattctatacgacaaatgtttcttctaacatccccacaatatcaccccttacaagacctcccttcagcttaatctctcccactctaggttcccacgccgcccctaatcccgcttgaagcagccctgagaaacatcgcccattctctctccataccaccccccaaaaattttcgccaccccaacacttcaacactattttgttttatttttcttattaatataagaaggcaggaatgtcaggcctctgagcccaagccaaaccatcacatcccctgtgacttgcacgtatatgcccagatggcctgaagtaactgaagaatcacaaaagaagtgaatatgcccagccccaccttaactgatgacattccaccacaaaagaagtgtaaatggctggtccttgccttaactgatgacattaccttgtgaaagtccttttcctggctcatcctggctcaaaagcacccccactgagcaccttgcgacccccactcctgcccgccagagaacaaaacccctttgactgtaattttcttttacctacccaaaacctataaaacggccccacccttaactcccttcgctgactcttttcggactcagcccacctgcacccaggtgaaataaacagccatgtcgctcacacaaagcctgcttggtggtctcttcacagggacgcgcatgaaa

SEQ ID NO: 444 - DNA, 978 bp, Homo sapiens
gtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagagcggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggc

SEQ ID NO: 445 - DNA, 5222 bp, Homo sapiens
gtcaggcccccgagcccatgctaagccatcatatcccctgcgacctgcaggtatacatccaggtggcctgaagtaattgaagaatcacaaaagaagtgaaaatggcctgttcctgccttaactgatgacattaccttgtgaaattccttctcctggctcatcctggctcaaaagctcccccactgagcaccttgtgtcccctgcccctgccagccagagaacaaccccctttgactataattttccactacctacccaaatcctataaaacggccccacccctatatcccttcactgactctcttttcggactcagcccacctgcacccaggtgattaaaaagctttattgctcacacaaagcctgttggtggtctcttcacacagacatgtgtgaaatttggtgccgtgactcagatcgggggacctcccttgagagatcaatcccctgtcctcctgctctttgctctgtgagaaagatccacctacaacctctggtcctcagaccaatcagcccaagaaacatctcaccaattttaaattgggtaagcggccgctttttactgtcttctccaagctctcactatccctcaacctctttctcctttcaaccttggcgccacacttcaatctctcccttctcttaatttcagttcctttccttttctggtagagacaaaggagacacattttatccgtggactcaaaactctggtgctggtcacggactcatgaagacagtcttcccttggtgtttaattattgcggggacgcctgctttggctgctcacccatattgcagcgcagggctgctcacccaaccccttctctctgtgtctctaccccttttccactttcccggggggcaagcacctcccaccccttctccactttcctggggggcaagcacccctcaccccttctctccatatctctaccctctcttttctctggactggcctccttctctacaggcaaccttccaccttcttctcccttagcctgtgttctcaagaactgaaaacctcttcaactcacacttgacctaaaacctaaatgccttattttcttctgcaatgctgcttaaccccaatacaaactcgacaatggttccaaatagccagaaaacagcactttcgatttttccatcctacaagatctagataattcttgtcataaaatgggcaaatggtctgaggtgcctgatgtccaggcattcttttacacatcagtccctccctagtctctgttcccaatgcaactcatcccaaatcttccttctttccctcccacctgtcccctcagtcccaaccccaagtgttgctgagtctttccaatcttcctttttcacagacccatctgacctctcccctcctccccaggctgctcctcaccaggccaagccaggtcccaattcttcctcagcctccgctcccccaccctataatccttttatcacctcccctcctcacacccagtctggcttacagttttttctgtgactaccctcccccacctgcccagcaatttcctcttaaaaacgtggctggagctaaaggcatagtcaaggttaatgctcctttttctttatccgacctctctcaaatcagttagtgtttaggctctttttcatcaaatataaaaactcaacccagctcatggctcatttggcagcaaccctgagatgctttacagccctagaccctaaaagatcaaaaggccctcttattctcaatatacgttttattacccaatccactcctgacattaaataaaactccaaaaattaaattctggccctcaaaccctgcaacaggacttaattaacctcgccttcaaggtgtacagtaatagagaagagttgcaattacttgcctccactgtgagagaaaccccagccacatctccagcacacaagaatttcaaaacgcctacgccacagtgatcaggtgttccttcaggacttcctcccccaggatcttgcttcaagtgctggaaatctggccactgggccaaggcatgcctgcagcctgggattccttctaagccttgtcccatctgtgcgggaccccactggaaatcggactgttcaagtcacctggcagcctctcccagagcccctggaactctcgcccaaggctctctgactgactccttcccagatcttcttggcttagaggccgaagactgacactgcccaatcacctcggaggcttcctagaccatcacagatgctttgggtaactcttacagtggagggtaagttcaacctcttcttaatacagaggctacccactccacattaccttcttttcaagggcctgtttcccttgcctccataactgttgtgggtattgacggccaggcttctaaacctcttaaaactccccaactctggtgccaacttggacaacattcttttatgcactcctttttagttatccccacctgcccagttcccttattaagccaagacattttaactaaattatctgcttacctgactattcctaggctgcagccacacctcattgccacccttttccccagttcaaagccttcttcacatcctccccttgtatctctccaccttaatccacaagtataggacacctctactccctccttggcaatggatgatgcaccccttaccatcccattaaaacctaatcacccttaccccactcaacgccaatatcccatcccacagcacactttaaaaggattaaagcctgttataccttgcctgttacagcatggccttttaaagcatataaactctccttacaattcccctattttacctgtccaaaaaccagacaagccttacaggttagttcaggacctgcaccttatcaatcaaattgtcttgcctatctaccccatggtgccaaacccatatactctcctatcctcaatacctccctccgcaacccattattctgttctaggaaacctagctgaccccatagatcctaaatcctttccccactcctctttctgttccttgaagacagctttagagactgctcccacactagctctccctgactcatcccaacccttttttcattacacacaaccaaagtgcagggttgtgtggttgaaattcttacacaagagctgagaccacgcccagcagcctttttatccaaacaagttgaccttactgttttagcctagccctcatgtctgtgtgtggcagctgctgctgccttaatacttttagaagccctcagaatcacaaactatgctcatctcactctctacagttctcataacttccaaaatctattttcttcatcacacctgatgcatatactttctgcccccctccactacctctcagcaagccgaactcattgccttaactcgagccgtcagtcctgcaaaaggactacatgtcaatatttatactgactctaaatatgccttccatatcctgcaccaccatgctgttacatgggcaaaaacaggtttcctcactatgcaattgtcctccatcattaattcctctttaataaaaactcttctcaaagccgctttacttccaaaggaagctggagtcattcactgcaagggccatcaaaagtgtcagatcccattgctcagggcaacacttatgctgataaggtagctgaaaaagcagctagggttccaacttccgtccctcactacgagtttttctccttctccttggtcactcccacctactcccccactgaaactgccgcctatcaatctcttcccacacaaggcaaatggttcttagaccaaggaaaatatctccttccagcctcacaggcccattctattctgtcatcatttcatatcctcttccatgtaggttacaagccactagcccgcctcttagaatctctcatttcctttccattgtggaaatctatccttagggaaatcacttctcagtgttccatctgctattctactactcctcagggattgttcaggtcccctcaccttccctacacatcaagcttggggatttgcccctgcccaggacaggtaaattgactttactcacatgcctcgagtcaggacactaaaatacctcttggtctgggtagacactttcactggatgggtagaggcctttcctacagggtctgagaaggccatcacagtcatttcttcccttttgtcagacataattcctcggtttggccttcctacctttatacagtctgataacggaccggcctttattagtcaaatcacccaagcagtttctcaggctcttggtattcagtggaacctttgtacccctcaccatcctcaatcttcaggaaaggtaaaatggactaatggtcttttaaagacatacctcaccaagctcagcctccaacttaaaaaaaaaaaaggagtctgtcaagaatagagcccaaaaactcaccaaccaaacaagtaattatgctgaacccccttggatactctctaattggatgtcctgggtcctcccaattcttagtcctttaataccagtttttctccttctcttattcagaccttgtgtcttccgtttagtttctcaattcatacaaaaccgcgtccaggccatcaccaatcattctatatgacaaatgctccttttaacaaccccacaatatcgccccttaccacaaaatcttccttcagcttaatctctcccactctaggttcccataccacccctaatcctgctcaaagcagccctgagaaacatcgcccattatctcttcataccaccccaccaaaattttcactgcctcaacacttcaacactattttatgttatttttcttattaatataagaagacaggaatgtcaggcctctgagcccaagctaagccatcatatcccttgtgacctacaggtatacatccagatggcctgaagtaactgatgaatcacaaaagaagtgaaaatggcctgttcctgccttaactgataatattaccttgtgaaattccttctcctggctcatcctggctcaaaagctcccccactgagcactttgtgtcccccgcccctgccagccagagaacaaccccctttgactgtaattttccgctacctacccaaatcctataaaatggccccacccctatctcccttcactgactctcttttcgaactcagcccacctgcacccaggtgattaaaaagctttattgctcacacaaagcctgtttggtggtctcttcacatggatgcgagtgaaa

SEQ ID NO: 446 - DNA, 5355 bp, Homo sapiens
gtcaggcctctgagtccaagcctgcacgtgtacatccagatggcctgaggcaactgaagaaccacaaaagttgaaaatggccagttcctgccttaactgatgacattaccttgtgacattccttctcctggacaacaagtctccggagctccccgccgagcaccgtgtgaccaaccccccacccccaccccgcctcactgcccgaaagagaacaaccgtctttaactgtaattttcaactacctacctgaaccttataagactgccccacccctatctccctttgctgattctctttttggactcagtccacctgcaccaggtgattaaaaagctttattgctcacacaaagcctgtttggtggtctcttcatacagacgcgcgtgacatttggtgacgaagacccaggataggggactcttctgggacaccggtcccctgtccttgccctcactctgtgaagagatccacctacaacctctggtcctcagaccaaccagcccaaggaacatctcaccaatttcaaatcaggtaagtggtcttttcactctcttctccagcctctctcgctacccttcagtctccctgtccttccaattccagttctttttcctctctagtagagacaaaggagacacattttatctgtggaccccaaactcccacgctggtcatggactcaggaagacagtcttcccttggtgtttgatcatcacggggatgcctgccttgatcattcacccacattccattggtgtctgatcaccacaaggacacctgccttgatcattcatctacatttcctcggtggcaagtcaattgcgggaatgcctgctttggctgctcacccacattacagcccagggctgctcaccacccccttctccgtgtctctacttttctctttaaacttacctccttcattatggacaaccttccatcctccagtcccccttcttctcccttagcctgtgttttcaagaacttcaaatcggtccctccctaatctccgctcccaatgtgactcatcccaaatctttctttctctcctgtctgttccttcaatctccaccccaagctctgagtcctttgaatcctccttttctgtggacccatctgacctctcccctcctccccaggctgctcctcaccaagacgcgccgggtcccaattcttactcagcctccactcccccaccctataatccttctatcacctcccctcctcacacacacctcccctcctcacactctggcttacagtttctttctgcaactagccctccccccacctgcccaacaatttcctcttacagaggtggctggagatgaaggcatagtcaagattaatgctcctttttctttatccgacctctcccaaatcaattagcatttaggctgttttttatcaaatataaaaacccagcccagttcatggcccttttggcaacaacccttagatgctttaccgccctagacccagagaggccagaaggccgtcttattctcaatatgcattttattatccgatctgctcccgacattagaaaaagctccaaacattagattctggccctcaaaccctacaacaggacttagttaacctcgccttcaaggtgtacaataatagagaagaggcagccaagtggcaacgtatttctgagttgcaattacttgctttcattgtgagagaaactccagccacatctctagcacacaagaacttcaaaacacctaaaccgcagtggccaggcatttctccaggacctcttccccaaggattttgtttcaagtgctggaaatctggccactgggccaaggaatgcccacagcccgggattcctcctaagctgtgtcctatctgtgcaagaccccactggaaatcagactgtccaactcacccggcagccactcccagagcccctggaactctggcccaaggctctctgactgactccttcccacttagtggctgaagactgacactgcctgatcagctcagaagcctcctggactatcacagatgctttgggtaactcttacagtggtgggtaagtctgtccccttcttaatcaatagggaggctacccactccacattaccttattttcaagggcctttttcccttgcctccacaactactgtgggtattgacagtcaggcttctaaacctcttaaaattccccagctctggtgccaacttggacaacattcttttatgcactcctttttagttatccccacctgcccagctcccttattaggttgaggcattttaactaaattgtctgcttccctgactattcctgggctacagtcacacctcattgccacccttttccccagttcaaagcctccttcgcatcttccccttgtatctccctaccttaatccacaagtatgggatacctctactccctccttggcgatcatgcaccctttatcatcccattaaaacctaatcacccttgccccactcaatgccaatatcccatcccacagcaggctttaaaaaggttaaagcctgttatcacctgcctgttacaacatggcctcttaaggcctacaaactctccttacaacctttctatcctacctttccaaaaccagacaagtcttacaggctggtccaggatattcgacttatcaaccaaattatcttgcctatccaccccatggtgccaaatccatatattctcccatcttcaatacttccctccacaacccattattctattctggatttcaaagatgctttctttactattcctttatacccttcatcccagcctctcgttcctttcacttggattgaccctgacacccatcagtctcagcaatttaacccgggctgtaccgctgcaaagcttcagggacagtccccattacttcagtcaagccctttctcataacttactttctttccatccatctgcttctcaccttattcaatattttaatgaccttctactttgtagacccctgtgaaacttcccaaaaggacaccctcctgctcttccaacatctattctcaaaaagatattacatatccccctccaaagcccagatttcttcctcatccattacctatctcagcataattcttcataaagacacacgtgctctccctgctgatcatgtccagctaatctctcaaaccccaaccccttctacaaagcaacaactcctttccttcctaggcatggttgggtactttcgcctttggatacctggttttgctatcctaaaaaaaaacccattatataaactcagaaagggaaacctagctgaccctatagatcctaaatcctttcccaactcaatatttacactgactctaaacatgctttccatatcctgcaccaccatgctgttatatgggctgaaagaggtttcctcactacaccagggtcctccatcattaatgcctctttaataaaaactcatctcaaggccgcattacttccaaaggaagctggagtccttcattgcaaagccatcaaaaggcctcagatcccattgctcaaggcaacaattatgctgataagacagctaaagaagcagccagtatttttctttctcctctatcactcccacctactctcccactgaaacttccgcgtatcagtctcttcccacagaagccaaatggttcttggaccaagaaaaattcctctttccagcctcacaggctcatcccattctatcatcctttcataacctctaccttgtaggttacaagccttactaacccacatcttagaacctctcatttcctttaagacatttgcccttcatatcactccatccttggctaccttccccttcttctttgaactcttctcctagcctctcctcttgcttgcttatacccagccccatgaatagcagtgaaaggttactcatacacactatgcgctttctcatacaccataaaaatagaacctcccccctacccagttgccccatcaatccccattacaacctctaagggttgctgccctcactaaatccctaagagtctgggtgcagggtttcaaagatgctttctttactattcctttagacccttcatcccagcctctcttcactttcacttggactaaccctgagacccatcagtctcagcaacttaacctgggctgtgctgcctcaaggcttcagggacagcccccattacttcagtcaagcccttttggtgctccctctcatcttttcactttacatttccagttttgccttacaaaggtctcttcctcctctgtgattcctccacctacatgtgtctatccatcaattggacaggcacatgtacactagttttctttaccccccaaaatcaattttcaaatagggctgaacaacttcctattccccttatgacaccaacacttcactactattttgttttttattattattaatataaaaagacaggaatagtcctcaacttactcactactgaaaaagaaagactctgtacatttttaaatgaagagtgttgtttttacctaaatcaatctggcctgctacacgacaacataaaaaaactcaaggatagagcccaaaaactcaccaaccaaacaaataattacactgaacccccttggacattctctaattggatgtcctaggtcctctcaattcttagtccttcaatacctgtttttctccttctcttaatcagaccttgtgtcttctgtttagtttctcaattcaaacaaaacagtatccaggccatcaccaatcattctatatgacaaatgctccttctaacaaccccacaatatcaccctttaccccaaaatatttcttcagtttaatctctcccacactaggtttccaagccacccctaatccctctcgaagcagccctaagaaacatcacccattatcactccataccaccccccaaaatttttgctgctccaacacttgaccactattttgttttgtttttcttattaatataagaagacaggaatgtcaagcctctgagcccaagcctgcacgtatacatccagatggcctgaggcaactgaacaacctcaaaagaagtgaaaatggctggttcttgccttaactgatgacattaccctgtgacattccttctcctggacaataagtctccagagctccccactgagcaccttgtgacccctgccactgcccgcaagagaacaacctcctttaactgtaattttccactacctacccaaatactataaaactgcaccatcccatctccctttgctgactctcttttcagactcagcccgcctgcacccaggtgattaaaaagctttattgctcacacaaagcctgtttggtggtctcttcacatggatgcgtgtga

SEQ ID NO: 447 - DNA, 659 bp, Homo sapiens
gtcaggcctccgagcccaagcctggacgtgtacatccagatggcctgaggcaactgaagaaccacaagagaagtgaaaatggccagttcctgccttaactgacgacattgcctcatgaaattccttctcctggacagtgagtctcagaagttcccccacccagcaccctgtgacccctgcccctgcccgccagagaacaaacctctttgactgcaattttctgctacccacccagatcctataaaatggctccaccccatctccctttgctgaccacctgcacccaggtgattaaaaagctttattgctggccaggtgcggtggctcacgcctgtaatcccagcacattgggaggccgagacaggcggatcacgaggtcaggagatggagaccatcctgactaacacggtgaaaccccgtctctactaaaaatacaaaaaattagccgggtgtggtggcgggcgcctgtagtcgcagctactcgggaggctgaggcaggagaatggcgtgaacccgggaggcagagcttgcagtgagccgagatcgtgccactgcactccagcctgggtgactgagccagactccgtctccaaaacaaaaaaaagctttattgctcacacaaagcctgtttgatggtctcttcacatggactcgcatga

SEQ ID NO: 448 - DNA, 478 bp, Homo sapiens
ttacagtagtcagatagtcaggcatgagcagggcaggagagggctccgcctcaccacgaacatcaggcaaccatcaggtaagggtcaggtggttgttacccgtctctctaaaataataattgatcacagctggcaccagcagaaggcaatctccctatagatagaaaaaaaactgaaactggtgatcagcagctttctgataacatctcgggaattgggggagtgagctcaaacatgtgaagtgagaggcagaaagttggagtttaactggtaaatgacctttctaggagcattcggctggtaagggaagaatgcctcaagtgagcatgtgtataacttcagtaaacacactgcacatgctcagcttgcaagtactggcaggccactgcacatgcagacacccaaccccaagagaagaatcaagggagaagggacgcaagaccgcagaagtatgccaacatataaaacatataagtca

SEQ ID NO: 449 - DNA, 771 bp, Homo sapiens
gagagacaggactagctggatttcctaggctgactaagaatccctaagcctagctgggaaggtgaccgcttccacctttaaacacggggcttgcaacttagctcacacataaccaatcagatagtaaggagagctcactaaaatgctaattaggcaacaacaggaggtaaagaaatagccaatcatctcttgcctgagagcacaggggaagggacaatgctcgggatataaacccaggcattcgagccggcaacagcaaccccctttgggtcccctccctttgtatgggagccctgttttcactctattaaatcttgcaactgcactcttctggtccgtgtttgttacagctcgagctgagcttttgctcgccgtccaccactgctgtttgccgccgttgcagacccacgactgacttccatccctccagatctggcagggcacctcctgatccagcgaggtgcccattgccactcccaatcgggctaaaggcttgccattgttcctgcacggctgagtgcgtgtgttcatcctaatcaagctgaacactagtcactggattccacagttctcttccatgacctgcggcttctgatagagctataacactcaccgcatggcccaagattccattccttggaatccgtgaggccaagaaccccaggtcagagaatacaaggcttgccaccatcttggaagcggcccgtcgccatcttggaagcggcttgccaccatcttgggagctctgtgcgcaaggaccccccagtaaca

SEQ ID NO: 450 - DNA, 5925 bp, Homo sapiens
ctgactctcttttcggactcagcccgcctgcgcccaggtgaaataaacagccatgttgctcacacaaagtctgttttgttgtctcttcacatggacacgtgagacatttggcgctgaagacccaggtcagtgggactccttcaggagaccagtcccctgtcctcaccctcactccatgaagagatccacctacgacctcaggtcctcagaccaaccagcccaaggaacatctcaccgattttaattcgggtaagcagcctcattttactctcttctccaacctctctcactatccctcaacttctttctcctttcaatcttggcaccacccttcaatctctcccttctcttttttttttttgagacggagtctcgctctgtcacccaggctggagtgcagtggcgcgatctgggctcactgcaacctctgcctcccggattcaagcaattctcctgcctcagcctccagagtagctgggattacaggcatgtgccaccacgcccggctaatttttttgtatttttagtacagacagcgtttcaccatattggccaggctggtctcaaactcctgaccttgtgatccacccacctcgacctcccaaagtgctgggattacaggtgtgagccactgcacccggcctctcccttctcttaatttcaattcttttcattttctggtagagacaaaggacacacattttatccgtggacccaaaactccagtaccggtcacggacttgggaaggcagccttcccttggtgtttaatcattgcagagatgcctctctgatattcacccacgttccattggtgtctgatttccacggggatgcctgccttggtcattcacccacattcccttggtggcaagtcaactgcggggacgcctgctttggctgctcacccacgttgcagcccagagctgctccccaccccccttctccgtgtctctacccttctctttaaacttgcctccttcactatgggcaaccttccaccctccattcctccttcttctcccttagcctgtgttctcaagaacttaaaacctcttcaactctcacctgacctaaaatctgagcgtcttattttcttctgcaataccgcttggccccaatacaaacttgacagtagttccaagtggccagagaatggcactttcgatttgtctatcctacaagatctagataatttttgtcaaaaaaatggggaaatggtctgaggtgcctgacatccaggcattcttttacacattggtcccgcccgagtctctgctcccagtgagactcatcccaaatctttcttctttctctcctgtctgttccttcagtctccaccccaagctctgagtcctttgaatccttcttttctatggactcatctgacctctccccttctccccaggctgctcctggccaggccaagccaggtcccaattcttcctcagcctctgctccccccaccctaaaatccttctatcaccttccctcctcacatctggtctggcttaaagttttgttccgcgactagccctccccaacctgtccaaaaatttccccttaaagaggtggctggagctaaaggcgtagtcaaggttaatgctcctttttctttatccgacctctcccaaatcagttagcgtttaggctcttttttatcaaatataagaactcaacccagttcatggcccattagcagcaacccttagacgctttaccaccctagacccagaagttcctgaaggctgccttactcttaatatgcattttattacccaatcccctcccagcattagaaaaagctctaaaaattagattccggccctcaaaccccacaacaggacttaattaacctagccttcaaggtgtacaataatagagtagaggcaacgtatttctgagttgcaattacttgcctccactgtgagagaaaccccagccacatctccagcacacaagaacttcaaaacgcctgaaccacagcggccaggtgttcctccaggaccgcctcccccaggatcttgcttccagtgccggaaatctggccactgggccaaggaatgcccgcagcctggaattcctcctaagccgtgtcccatctgtgtgggaccccagtggaaatcagactctccaactcgcccggcagccactcccagagcccctggaactctggcccaaggctctctgactgactccttcccagatcttcttggcttagcggctgaagactgacgctgcccaatcacctcggaagcctcctggaccatcacagacactttgggtaactcttacagtggagggtaagtccgaccccttcttaatcaacacggaggctactaactccccattaccttcttttcaaaggcctgtttcctttgcctccataactgttgtgagtattgacggccaggcttctaaaccccttaaaactccccaactctggtgccaacttgaacaatattcttttatgcactcctttttagttatccccacctgcccagttcctttattaggtcaagacattttaactaaattatctgcttccctgactattcctgggttacagccacacctcattgctgccttttgccccggttcaaagcctccttcacattctctccttgtatctccccaccttaaaccacaagtataggatgcctctactccctccttggcaaccgatcatgcaccccttaccatcccactaaaacctaatcacccttaccccactcaatgccaatatcccatcccacagcacgctttaaaaggattaaagcctgttatcactcacctgttacagcatggtcttttaaagcctataaactctccttagaattccattttacctgttcaaaaactggacaagtcttacaattagttcaggatctgcaacttatcaaccaagttgttttgcctacccaccctgtggtgtcaaacccatatactctcctatcctcaatacatccctccacaacccctccataacccattattctgttctggatctcaaacatgctttctttactattcctttgcacccttcatcccagcctctcttcactttcactcgaactgaccctgacacccatcaggctcagcaaaatacctgggctatactactgcaaggtttcacagacagcccccattatttcagtcaagcccaaatttcttcctcatccattacctatctcgacataattcttcatgaaaacaaatgtgctctctctgctgattgtgtccggctaatctcccaaacgcttctacaaagcaacaactcctttccttcctgggcatggtaggatactttcgcctttagatacctggttttgccatcctaacaaaaccaatatatcaactcacaaaaccaaacctagctgaccccatagatcctaaatcctttcgccactcctctttctgttccttaaaaagagccctagaagctgcccccacactagatctccctaactcatcccaacacttttcattacacacagccgaattgcagggctgtgcagagttcttacacaagagccaggaccgtgccctgtagcctttctgtccaaacaatttgacctaactgttttagcctagccctcatgtctgcatgtggtggccgccgccaccctaatacttttagaggccctaaaaatcacaaaatatggtcaactcactctctacagctctcataacttccaaaatctattttcctcctcacacctgacgcatatactttctgctccctggctccttcagctatactcactctttgttgagtctcccacattaccattgctcctggcccagtcttcaatccggcctcctacattattccggataccacacctgacccccatgactgtatctctctgatccacctgacactcaccccatttccccatatttccttctttcctgttcctcaccctgatcacatttggcttattgatggcagttccacccggcctaatcgccacgcactagcaaaggcaggctgtgctatagtatcttccacatctatcattgaggctaccactctgcccccctccactatctctcagcaagccgaactcattgccttaactcggagcctcacccttgcaaagggactatgtgtcaatatttatactgactctaaatatgccttccttatcttgcaccaccatgctattataggggctgaaagaggtttcctcactacacaagggtcctccatcattaatgcctctttaataaaaactcttctcaagtccactttacttccaaaggaagctggagtcatacactgcaagggccaccaaaaggcatcagatcccatcgctcagggcaacgcttatgctgataaggtagctaaagaagcagctagaattcaaacttctgtccctcatggccagtttttctcctcatcataggtcactcccacctactcccccgctgaaacttccacctatcaatctcttcccacacaaggcaaatggttcttagaccaaggaaaatatctcattccagcctcacaggcccattctattctgtcgtcatttcataacctcttccatgtaggttacaagctgctagcccatctcttagaacctctcatttcctttccatcatggaaatctatcctcaaggaaatcacttctcagtgttccatctgctattctactacccctcaggtattgttcaggacccctccctttcctacacatcaagctcagggatttgcccctgcccaggactggcaaattgactttactcacatgctccgagtcagaaaactaaaatacctctcggtctgggtagacactttcactggatgggtagaggccttttccacagggtctgagaaggccaccgcggtcatttcttcccgtctgtcagacataattccttggtttggccttcccaccttgatacaatctgataacacaccggcctttattagtgaaatcaccgaagcagtttatcagtctcttggtattcagtggcgcctggttttacctcaaactgccacccttaagtctctctttaagtggatagaatatcttcagtgacaaagtacactccaatactttcaccctgatgaagtcctatactttacttttatacttactctaattctcattcccgttcttatgacaccctctacctctccccagctatctccaccacaatatcaaactcactctttcctagccatttctaatccttctttaacaaacaattgctggctttgcatttctctttcctccaaaattgccaaggcctcgacttagtcactgctaaaaaaagaagactgtatatttttaaatgaagaatgctgtttttacctaaatcaatctggcatggtatatgacaacataaaaaaactcaaggatagagcctaaacttgtgccaaccaagcaagtaattatgctgaacccccttggacgctttgtaattggatgtcctgggtactcccaattctttgtcctttaacacctgtttttctccttctcttatttggaccttgtgtctttcatttagtttctcaattcatacaaaatcgcatccagaccatcaccaataattctatacgataaatgctccttctaacagccccacaatatcaccccttgccccaaaatctttcttcagtttaatctctcccactctaggttccctcgccgcccgtaatcccgcttgaagcagccctgagaaacaccgcccattatctctccatacctccccccaaaattttcgccacctcaacacttcaccaccattttgttttgtttttcttatcaatataagaagacaggaatatcaggcctctgagcccaagctaagccatcatatcccctgtgactagcacatatacatccagatggcctgaagcaactgaagatccacaaaagaagtgaaaatagccttaactgatgacattcca

SEQ ID NO: 451 - DNA, 967 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcacgctcattaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccttaaagggtctgtgctgaggaggattagtaaaagaggaaggaatgcctcttgcagttgagacaagaggaaggcatctgtctcctgcccgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaggggaactcagaggctggcgggatcctccatatgctgaacgctggttcctctgttccccttatttctttctctatactttgtctctgtgtctttttcttttccaaatctctcgtcccaccttaggagaaacacccacaggtgtgtaggggcaacccacccctaca

SEQ ID NO: 452 - DNA, 389 bp, Homo sapiens
gtcaggcctctgagcccaagctaagccatcatatccccagtgacctgcatgtatacatccagatggcctgaagcaagtgaagaatcacaaaagaagtgaaaatggccggttcctgccttaactaatgacattaccttgtgaaattccttctcctggctcagaagctcccccactgagcaccttatgacccccccacccctgcccaccagagaacaacaaccccctttgactgtaattttccactacctacccaaatcctataaaacggccccacccctgtctcctttcccagactctcttttcggactcagccagcctgcacccaggtgattagaaagctgtattgctcacacaaagcctgtttgttggtctcttcacacggatgcatg

SEQ ID NO: 453 - DNA, 5148 bp, Homo sapiens
cttctttgggtcccctccctttgtatgggagctctgttttcactcttaaatcttgcaactgcactcttctggtccgtgttttgttatggctcgagctgagttttcgctcaccgtccaccactgctctttgccgccatcacagacccgctgctgacttccatccctccggatccggcagggtgtctgctgtgctcctgagcgcccattgccgctcccgattgggctaaataaaggcttgccattgttcctgcatggctaagtgcccgggttcgtcctaatcaagctgaacactagtcactgggttccacggttctcttccgtgacccacggcttctgatagggctataacactcacagcatggcccaagattccattccttggaatccgtgaggccaagcacccttggtcagagaacacgaggcttgccaccatcttagaagcggcccaccaccacattaggagctctgggagcaaggaccccccggtaacatttggcaaccatgaagggacctccaaagtaatgggaaacgttccccccaaggcaaaaacacccctaagatatattctggagaattgggaccaatttgactctcagacactaagaaagaaacgacttatatttttctgcagtaccacctggccatgatatcctcttcaagggggagaaacctggcctcctgagggaagtataaattataacaccatcttacacctagacctcttttgtagaaaagaaggaagagtgaagtgccatatgtacaaactttcttttcattaagagacaactcgcaattatgtaaaaagtgtgatttatgccctacaggaagccctcgagtctacctccctactccggtgtccccccaactgcttccccaactaataaggacaccccttcaacctaaacgatccaaaaggagatagacaaaggggtaaacaatgaaccaaagagtgccaatattccccaattatgccctctccaagtggtgggaggaggagaatttggcccagccagagtacacgtacctttttctctctcagacttgaagcaaattaaaatagacctaggtaaattctcagataaccctgatggctatattgatgttttacaagggttaggacaatcctctgatctgacatggagatataatgttactgctaaatcagacactaacgccaaatgagagaagtgccatcataactgcagcccgagagtttggcgatctctggtatctcaggtcaatgataggatgacaacagaggaatgagaacgattccccacaggccagcaggcagttcccagtgtagaccctcactgggacacagaatcagaacatacagattggtgccgcaaacatttgctaccttgcgtgctagaaggactaaggaaaactaggaagaagcttatgaattattcaattatgtccactataacacagggaaaggaagaaaatcctaccgcctttctggagagactaagggaggcattgagaaagcacacctctctgtcacctgactgtactgaaggccgactaatcttaaaggataggtttatcactcagtcagctgcagacattagaaaaaacttcaaaaaacttagaaaccctgttgaacttggcaaccttggttttttgtaatagagatcaggaggagcaggcagaacgggacaaatgggataaaaaaaaggccaccgctttagtcatggccttcaggcaagcggactttggaggctctggaacacggaaaggctagggaaattgaatgcctaatagggcttgcttccagtgcggtctacaaggacactttaaaaaagattgtccacatagaaataagccgccccctcgtccatgcccgttatgtcaagggaatcactggaaggcccactgccccaggggacgaaggtcctctgagtcagaagccattaaccaaatgatccagcagcaggactgagggtgcccagggcaagtgccagctcatgccatcaccctcacagagccccgggtatacttgaccattgagggccaggaggttaactgtctcttggacactggcgcggccttctcagtcttactctcctgtcctggacaactgtcctccagatctgtcactatccaaggggtcctaggacagccagtcactacatacttctctctcagccactaagttgtgactggggaactttactcttttcacatgcttttctaattatgcctgaaagccccactcccttgttagggagagacattctagcaaaagcaggggccattatacacctgaacataggagaaagaacacccatttgttgtcccctgcttgaggaaggaattaatcctgaagtctgggcaacagaaggacaatatggacgagcaaaaaatgcccatactgttcaaattaaattaaaggattctgcctcctttccgtaccaaaggcaatacccgcttagacccaaggcccaacaaggactcaagaaaattgttaagaacctaaaagcccacggcctagtaaaaccatgcaatagcccctgcaatactccaattttaggggtatagaaacccaacagacagtgaacgttagtgcaagatctcaggattatcagtgaggctgttgtccctttatacccagctgtacctaaccgttgtactctgctttcccaaataccagaggaagtagagtggtttacagtcctggaccttaaggatgcctttttctgcatccctgtacatcctgactctcaattcttgtttgcctttgaagatccttcaaacccaatgtctcaattcacctggactgttttaccccaagggttcagggacagcccccatctatttggccaggcattagcccaagacttgagccagttctcacacctggacactcttgtccttcagtacatggatgatttacttttagctgccctttcagaaaccttgtgccatcaagccacccaagcgctcttaaatttccttgccacctgtggctaccaggtttccaaaccaaacgctcagctctgctcacagcaggctaaatacttagggctaaaattatcctaaggcaccagggccctcagtgaggaatgtacccagcccacactggcttatcctcatcccaaaccctaaagcaactaagaggattccttagcataacaggcttctgccaaatatggattcccaggtatggtgaaatagccaggccattatatacactaattaaggaaactcagaaagcaatacccatttagtaaggtggaaacctgaagcagaagcagctttccaggccctaaagaaggccctaacccaagccccagtgttaagcttgccaacggggcaagacttcgtatatatcacagaaaaaacagggatagctctaggagtccttacacatgtctgagagacgagcttgcaacctgtggcatacctgagtaagaaaactgatgtagtggcaaagggttggcctcattgtttatgggtaatggcagcaatagcagtcttaatatctaaagcagttaaaatgatacagtgaagagatcttactgtgatctcatgatgtgaacggcatactcactgctaaaggagacttgtggctgtcagacaaccatttacttaaatatcaggctgtattacttgaagggccagtgctgcgactgtgcacttgtgcaactcttaacccagccacatttcttccagacaatgaagaaaagatagaacataactgtcaacaagtaattgctcaaacctatgccacttgaggggaccttttaggggttcccttgactgatcccaacctcaacttgtatactgatggaagttcctttgtagaaaaaggacttcaaaatgcggggtatgcctcagtgataatggaatacttgaaagtaatcccctcactccaggaactagtgctcagctggcagaactaatagccctcactcgggcactagaattaggagaaggaaaaagggtaaatatatatacagactctaagtatgcttacctagtcctccatgcccatgcagcaatatggagagaaaaggaattcctaacttccgagggaagacctatcaaacatcaggaagccattaggaaattattattggctgtacagaaacctaaagaggtagcagtcttacactgctggggtcatcagaaaggaaaggaaagggaaatagaagggaactaccaagcagatattgaagcaaaaagagctgcaaggcaggaccctccatcagaaatgcttatagaaggacccctaatatggggtaatcccctctgggaaaccaagcccctgtactcaaaagaagaaatagaatggggaacctcaggaggacatagtttcctcccctcaggatggctagccactgaagaaggaaaaatacttttgcctgcagctaaccaatggaaattatttaaaacccttcaccaaacctttcacttaggcattgataacacccatcagatggccaaatcattactggaccaggccttttcaaaactatcaagcagatagtcagggcctgtaaagtgtgccaaagaaataatcccctgcactgcaggccatgcatttcaatccctgtatctctaacctccttgttaagtttatctcttccagaatcgaagctgtaaaactacaaatcgttcttcaaatggagtccccgatgcagtccatgactaagacctaccgtggacccctggactggcctgctagcccatgctctgatgttaatgacatcaaaggcatccctcccaaggaaatctcaactgcacaacccctactatgccccaattcagcagaaagcagttagagcggtcatcggccaacctccccaacagcacttgggttttcctgttgagaggggggactgagagacaggactagctggatttcctaggccgactaagaatccctaaggctagctgggaaggtgaccacatccacctttaaacacagggcttgcaacttagctcacacccaaccaatcaggtagcaaagagagctcgttaaaatgataattaggcaaaaacaggaggtaaagaaatagccaatcatctatcgcctgagagcacagcaggcattcgagccggcaatggcaaccctctttgggtctcctccctttgtatgggagctctgttttcactctattaaaccttgcaactaca

SEQ ID NO: 454 - DNA, 763 bp, Homo sapiens
gagagataggactagctggatttcctaggccaactaagaatccctaagcctagatgggaaggtgaccgcttccacctttaaacatgggacttgcaacttagctcacacccgaccaatcaggtagtagagagagctcactaaaatgctaattaggcaaaaacaagaggtaaagaaataggcaatcatctactgcctgagagcacagtgggagggacaatgatcgggatctaaacccaagtattcgagccggcaatggctaccctctttgggtcccctccctttgtatgggagctctgttttcactctattaaatcttgcaactgcactctcttctggtccatgtttgttactgctcgagctgagctttcgatcaccatccaccactgctgtctgccaccgtcgcagacctgccgctgacttccatccctccagatcaggcagggtgtccactgtgcttctgatccagcgaggtgcctattgccgcccccgatcgggctaaaggcttgccattgttcctgcacagctaagtgcccaggttcatcctaatcgagctgaacactagtcactgggttccacagttctcttccatgacccaaggcttctaatagagctataacactcactgcatggccccagattccgttccttggaatctgtgaggccaagaaccccacgtcagagaacacgaggcttgccaccatcttggaaacggccccccaccatcttgggagctctgggagcaaggactccccagtaacagttt

SEQ ID NO: 455 - DNA, 4487 bp, Homo sapiens
cttctcccttagcctgtgttcttaaaaacctaaaaacctctttaactcacgcctgacctaaaacctaaatgccttattttcttctgcaatgccacttgaccccaatacaaactcgacagtggttccaaatagccagaaaatggcactttcaatttttccatcctacaagatctaaataattcttgtcataaaatgggcaaaaggtctgagatgcctgatatccaggcattctttcacacatgggtccctccctagtctctgttcccaatgcaactcgtcccaaatcttccttctttccctcctgcctgtcccctcagtcccaaccccaagcatcgctgagtctttctaatcttccttttctacagacccatctgatctctcccttcctcgccaggctgagctaggtcccaattcttcctcagcctctgctcctccaccttataatccttttatcaactcccttcctcacacccagtccagcttacagttttgttccatgactagccctcccccacctgcccagcaatttactcttaaaaagatggctggagctaaaggcacagtcaaagttaatgctcctttttctttatcccaaatcagatagcgtttaggctctttttcatcaaatataaaaacccagcccagttcatggctcatttgtcagcaaccctgagaagctttacagccctagaccctaaaaggtcaaaaggccgtcttattgtcaatatacattttattacccaatctgctcccgacattatgtaaaactccaaaaattaaattccggccctcaaagcccacaacaggacttaattaacctcaccttcaaggtatacaataatagaggcagccaagtagcaacatatttctgagttgcaattccttgcctccactgtgagacaaaccccagccacatctctaacacacaagaacttccaaacgccgaaaccgcagtggccaggcattcctccaggcccgcctcccccaggagcttgctacaagtgccagaaatctggccaccaccaggccaaggaatgcctgcagcccaggattcctcctaagccacgtcccatctgtgtgggaccccactgaaaatcggactgttcaactcacctggcagccactcccagagcccctggaactctggcccaaggctctctaactgactcctttccagatcttctcagcttagtggctgaagactgatgctgcccgatcacctcggaagccccctagaccatcacggacgccgagctccaggtaactctcacagtggagggtaagtccgtccccttcttaatcaatacggagactacccactccacattaccttcttttcaagggcctgtttcccttgcctccataactgttgcaggtattgacggccaggcttctaaacttcttaaaactccccaattctggtgccaacttagacaatactattttaagcactccttttagttatccccacctgcccagttcccttattaggctgagacacttgaactaaattatctgctcccctgactattcctgggctacagctacatctcattgccatctttttgcccagttcaaagcctccttcacatcctccccttgtatctccccaccttaacccacaagtataggacacctctactccctcctcagtgaacgatcatgcaccccttaccatcccattaaaacctaatcaccctcaccctgttcaatgccaatattccatcccacagcacgctttaaaaggattaaagtctgttattacttacctgttacagcatggccttttaaagcctataaactctccttaacaattcccccattttacctgtcctaaaaccagacaagacttacaggttagttcaggatctgcaccttatcaaccaaattgttatgcctatccaccctgtgctgccaaacccatatattctcctatcctcaatacctccctctacaacccattattctgttctggatctcaaacatgctttctttactattcctttgctatttctttactatttctttactatttctttactattctttactattcctttactatttctttactattcctttgcacccttcatcccagcctctcttcgctttcgcttggactgaccctgacagccattaggctcagcaaattacctgggctgtactgccacaagtcttcacagacagcccccattacgtcagtcaagcccaaatttcatcctcatctgttacctatctcagcataattctcataaaaacacatgtgctctctctgccgatcatatccgactgatctctcaaaccccagcaccttctacaaaacaatttgtttccttcctaggcatggttagtgcagtcagaagtcttacacaagagccaggaccacaccctgtagcctttttatccaaaaaacttgaccttactgtttggcctagccctcaagtctgtgtgcagcggccgccgctgccctaatacttttagagacccttaaaatcacgaactatgctcagctcactctctacagttctcataacttgcaaaatctattttcttcctcacatctgacacacatactttctgctcccggctccttcagctgtactcactctttgttgagtctcccacaattgccattgttcctggcctggacttcaatcccacctcccacattattcctgataccacacctgactcccatgactgtatctctctgatccacctgacattcacctcatttccccatatttccttctttcctgttcctcaccctgatcacacttggtttattggtggcagttccaccaggcctaattgccacacaccagcaaaggcaggctatgctatacactagcccgcctcttagaacctctcatttccttcccatcgtggaaatctatcctcaaggaagtaacttctcagtgttccatctgctgttctactactcctcagggattatccaggctccctcccttccctacacatcaagctcgaggatttgcccccacccaggactggcaaattgactttactcctgtgcccccagtcagaaaactaaaatacctcttagtctaggtagacactttcactggataggtagaggcctttcctacagggtctgagaaggccaccacagtcatttcttcccttctgtcagatataattcctcagtttagccttcccacctctacacagtccaatagcagaccggcctttattagtcaaatcagccaagcattttttcaggctcttggtattcagtgaaacctttatataccttacagtcctcagtcttcaggaaaggtagaacagactaatggtcttttaaaaacacacctcaccaagctcagccaccaacttaaaaaggactggacaatactttttaccattttcccttctcagaattcaggcctgtccttggaatgctacagggtacaacccatttgagttcctgtatggatgctcctttttattaagccccagtctcaccagaccaacttggactgtaccccaaaaaatttgtcatccctactattttctgtctagtcatactcctattcaccgttctcaactactcgtgcatgctctgctcttgtgtatactgccggtttacagtgtttctccaagccttcacagctgatatctcctggtgctatccccaaaccgccactcttaactcttaaagtaaataaataatctttgctggcaggactatgctgaatctccttaggcaccctctaattagatgtcctgggtcctcccaattcttaggcctttaatacctgtttttctccttctcttattccatttagtttttcaattcatacaagactgtatccaggccatcaccaataattctatatgacaagtgtttcttctaacagtcctacagtatcaccccttaccacaaaatcttccttcagcctaatctctcccactctaggttcccacgccacccctaatcctgcccaaagcagccctgagaaacatcacccattatctctccataccaccccccaaaaaattttcaccatcccaacactttaccactattttgttttaattttcttattaatataagaagacaggaatgtcagaactctgagcccaagctaagccatcatatcccctgtgacttgcacctacacatccagatggccagttcctgccttaactgatgacattccaccacaaaagtagttaaaatggccggtccttgccttaagtgatgacattaccttgtgaaagtccttttcctggctcaaaaagctcaaaaagcaccttgtggtccccagtcctgcccaccagagaacaaatcccctttgactgtaattttcctttatctacccaaatcctataaaatggccccacccttatctcccttcactgactctcttttcggactcagcctgcctgcacccaggtgattaaaagctttattgctcacacaaagcctgtttggtggtctcttcacatggatgcacatgaaa

SEQ ID NO: 456 - DNA, 5634 bp, Homo sapiens
gtcaggcctctgagccaaagctaagccatcatatcccctgtgacctgcacatacacatccagatggctggttcctgccttaactgaggacattcaaccacaaaagaagtgaaaatggctggtccttgccttaactgatgacattaccttgtgaaattcattttcctggcccatcctggctcaaaagctcccccactgagcaccttgtgacccccacccctgcccgccagagaacaaccccctttgactataattttcctttacctacccaaatcctataaaatgaccccacccctatctccctttgctgactctctcttcagactcagcccgcctgcacccaggtgaaataaacagccttgttgctcacacaaagcctgtttggtgggctcttcacacggacgggagtgaaattttggtgccgtgactcggatcgggggacctcccttgggagatcaatcccctgtcctcctgcactttgctccatgagaaagatccacctacgaccttgggtcctcagaccgaccggcccgaggaacaactcaccaattttaaatcgggtaagtggccttttttttactctcttctccaacctctcttactatccctcaacctctttctcctttcaatcttggcaccacacttcaatctctcccttaatttcagtacctttccctttatgttagagacaaaggagacacattttatccgtgaacccaaaactccggcgctggtcacggactcaggaagacagtcttcccttggtgtttaatcacacggggatgcctgcctgattattcacccacatttcagaggtgtctgaccacgtggggatgcctgccttggtccttcacccttagtggcaagtactgcttttctgggggacaagaaacccctgaccccttctctccatgtctctaccccttctctgcttttctagggggcaagaaccccccgccccttctctccgtgtctctactctctcttttctctgggcttgcctccttcactatgggcaatcttccaccctccattcttccctctactcccttagcctgtgttctcaagaacttaaaacctcttcaattcacacctgacctaaaacctaaacaccttattttcttctataatcctgcctgaccccaatacaaactcgacagtggttccaaatagccagaaaacagcgcttttgatttttccaacctacaagatctaaataattattgtcgtaaaataggcagtctgaggtgcctgacgtccaggcattcttttacacaccggtcccccccagtctctgttcccaatgcaacttgtcccaaatcttccttctttccctcccgcgtgtcccctcagtcccaaccccaagcatcactgagtctttctaatctgccttttctacagacccatctgacctcctccccaggctgctccttgccaagccgagctaagtcccagctcttcctcagcctctgctcccccaccctataatccttttatcacttcccctcctcacacccggtccagcttacagtttcgttccgagactagccctcccccacctgcccagcaatttctcttaaaaaggtggctagagctaaaagcatagtcaaggttaatgctcctttttctctatccaacctctcccaaaatcagttagcgtttaggctcttcatcaaatatgaaaaaccccgcccagttcatggcctgttcggcagcaaccctgagacgctctacagccctagaccctgaaaggtcaaaaggccatcttattctcaatatacattttattttattacccaatctgctcccgacattaaataaagctccaaaaattaaattccggccctcaaaccccacaacaggatctaattaacctcgccttccaggtgtacaataatagagtagaggcagccaagtagcaacatatttctgagttgcaattccttgcctccactgtgagagaaaccccagccacatctccagcacacaagaacttccaaacgcctgaaccgcagtggccaggcgttcctccaggcccatgtcccccaggagctcgctacaagtgccagaaatctggccaccaggccaaggaatgcccacagcccaggattcctcctaagccatgtcctatctgtgcaggaccccactggaaatcggactgtccaactcacctggcagccactcccagagcccctggaactctggcccaaggctctctgactccttcccagatcttcttcgcttagtggctgaagactgacgctgcccaatcacctcggaagcttcctggaccatcacagacgctctgggtaactctcacagtggaagggaagtccatccccttcttaatcagtacagaggctacccactccacattaccttcttttcaagggcctgtttcccttgcctccataactgttgtgggtattgacggccaggcttctaaacctcttaaaactccccaactctggtgccaacttagacaacactcttttaagcactcctttttagttatccccacctgcccagctcccttattaagccaagatattttaactaaattatctgtttccctgactattcctgggctatagccacacctcattgctgcttttcccccagttcaaagcctccttcacatcctccccttatatctccccaccttaatccacaagtataagacacctctacttcctccttcgcgaccgatcatgcaccccttaccatctcattaaaacctaatcactcttaccccgttcaatgccagtatcccatcccacagcatgctttaaaaagatcaaagtctgttatcactcgcctgctacagcatggccttttaaagcctataaactccccttacaattccccaattttacctgtcctaaaaccagacaagccttacaggttagttcaggatctgcgccttatcaaccaaattgttttgcctatccaccctgtggtgccaaacccatatactctcctatcctcaatgcctccctccgcaacccattattctgttctgggtctcaaacatgctttctttactattccttttcacccttcatcccagcctctcttcgctttcacctggactgaccctgacacccaccaggctcagcaaattacctggactgtactgccgcaagtcttcacagacagctcccattacttcagtcaagcccaaatttcttcctcatctgttacctatctcggcataattctcataaaaacacacgtgctgtctctgccgatcatgtccgactgatctctcaaaccccaacaccttcacaaaacaaaactcctttccttcctaagcatgggtagatactttcgactatagatacctggttttgccatcctaacaaaaccattatataaactcacaaaaagaaacctagctgaccccgtagatcctaaatcctttccccactcctctttctgttccttgaagacagcttaaagactgcccctaccctacctgtctctgactcatcccaacccttttcattacccacagccaaagtgcaaggctgtgcagtcagaattcttacacaaggaccaggactgtgccctgtagcctttttatccaaacaacttgaccttactgttttgcctagccctcaagtctgcgtgcggtggccaccaccaccctaatacttttagaggcccttaaaatcacaaacaatgctcaactcactctctacagttctcataacttccaaaatctattttttcctcacacctgacacatatactttctgatccccagctccttcagctgtactcactctttgttgagtctcccacaattaccattgttcctggcccggacttcaatctggcctcccacattattcctgataccacacctgaccctcatgactgtatctctctgatccacctgacattcaccccatttccttctttcctgtttctcaccctgaacacacttggtttagtgatggcagttccaccaggcctaatcgccacacaccagcaaaggcaggctatgctatagaacaagccaccagcccgcctcttagaacctctcatttcctttccatcgtggaaatctatccttaaggaaataacttctcagtgccatctgctattctactactcgtcagggattattcaggccccctcccttccctacacatcacgcttgaggatttgccccgcccaggactggcaaattggctttactcaacatgccccgagtcaggaaattaaaatacctcttggtctaggtagacactttcactggataggtagaagcctttcccacagggtctaggaaggccaccatggtcatttcttcccttctgtcagacataattcctcagtttgaccttcccacctctatacagtccaataacagaccggcctttattagtcaaagcacccaagcagtttctcaggctcttagtattcagtgaactaatggtcttttaaaaactcacctcaccaagctcagtcaccaacttaaaaaggactggacaatacttttaccacttgcccttctcagaattcaggcctgtcctcggaatgctacaagatacagcccatttgaactcctctatagacgctcctttttattaggccccagtctcattccagacaccagaccaacttggactgcaccccaaaaaacttgtcatccctactatcttctgtctagtcatactcctatttaccgttctcaaccactcataaatgccctgctcttgtttacaccgccggtttacactgtttctccaagccatcacagctgatatctcctggtgctatccccaaaccgccactcttaactccctcttaaagtaaataaataatctttgctggcagggctatgctgaaaaggcactctctagttagatgttctaggtcctcccaattcttagtcctttaattcctgtttttctccttgtcttattccgtttagtttttcaattcatacaaaaccgtatccaggccatcaccaacaattctatacaacaaatgtttcttctaacaaccccacaatatcaccccttaccacaaaatcttccttcagcttaatctctcccactcgaggttcccacgccacccctaatcccgcttgaagcagccctgagaaatatcgcccattctctctccataccaccccccaaaattttcgctgccccaacacttcaacactattatgttttatttttcttattaatataagaagacaggaatgtcaggatgctgagccaaagctaagccatcatatcccctgtgacctgcacgtacgcatccagatggccagttcctgccttaactgaggacatatcaccacaaaagaagtgaaaatggccggtccttgccttaactgacgacattaccttgtgaaattccttctcctgggtcatcctggctcaaaagctcccccactgagcaccttgtgacccccacccctgcccaccagagaacaaccccctttgactgtaattttcctttacctacccaaatcctataaaacggccccacccctatctccctttgctgactctctcttcagactcagcccgcctgcacccaggtgaaataaacagccttgttgctcacacaaagcctgtttggtggtcttttcacacggacgtgagtgaaa

SEQ ID NO: 457 - DNA, 697 bp, Homo sapiens
ttagactaggtagttaggcagacatgagcagagtgggagaggggtcccccttatactaggaatgtcaggacaccatcaggtgatggctagacagttcttaaactgcctctctaaaataattggttgtagctggtgccaggaaaggcagtttcccagtagatagagaacacctgaagctgatgatcagcggcttcctaataagatctcaggagttgggtgagtgggctcaagcatgagcactaaaaggcaaactggcacgtttaactggtatatgaccttgctctaggaacatttgtctggtgagggaagaatgcctcaagtgagcatgcgtacaacttcaataagcacattgggcatgcagcccctcccaagtgcggacaggccattgcgcatgtcgacagcccaccctaagggaagaatcaaggtagaagtaacacagaccctggaatcatgccaatgtataaagccccaaggcaaaggtcaaacagtgcacttgaatctctcaagtcacctgcttggccctcttccagtgtactttacttccttttgttcctgctctaaaactttttaataaactttgactcctattctaaaacttgccttagtctcttgcattgccttatggcccctcagtcaaattctttcttctgaggaggcaagaattaaggtggctgcagacccatatggatttggtgca

SEQ ID NO: 458 - DNA, 406 bp, Homo sapiens
gtcaggcctccgagcccaagctaagccatcatatcccttgtgacctgcatgtatacatccagatggcctgaagtaactgaagaatcacaaaagaagtgaaaatggcctgttactgccttaactgatgacattaccttgtgaaattccttttcctggctcatcctggctcaaaagcttccccactgagcaccttgtgtcccccgcccctacctgccagagaacaaccccctttgactgaaattttcctttacctacccaaatcctataaaacagccccacccctatctgccttccctgactctgagtcccttccaggactcagcctgcctgcacccaggtgaaataaacagccttgttgctaacacaaagcctgtttggtggtctcttcacacggacaccagtgaaa

SEQ ID NO: 459 - DNA, 400 bp, Homo sapiens
gtcaggcctctgagcccaagctaagccatcatatcccctgtgacctgcacatacacatccagatggctggttcctgccttaactgatgatattccaccacaaaagaagtgaaaatggccggttcctgccttaactgatgacactaccttgtgaaattccttctcctggctcatcctggctcaaaacgtcccccgctgagcaccttgtgatcctcacccctgcccaccagagaacaacccccctttttcctttacctacccaaatcttataaaacggccccactcctatctcccttcgctgattctcttttcggactcagcccacctgaaacccaggtgaaatagccttgttgctcacacaaagcctgtttggtggtctcttcacatggatgtgagtgaaa

SEQ ID NO: 460 - DNA, 4570 bp, Homo sapiens
caggcctctgagcccaagccaagccatcgcatcccctgtgacttgcacgtatatgcccagatggcctgaagtaactgaagaatcacaaaacaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgtgaccccccactcctgcccactgagcaccttgcgacccccactcctacccgccagagaacaaaccccctttgactgtaattttcctttacctacccaaatcctataaaacggccccacccttatctcccttcgctgactctcttttcggactcagcctgcctgcacccaggtgaaataaacagccatgttgctcacacaaagcctgtttggtggtctcttcacacggacgtgcatgaaatttggtgccgtgactcagatcgggggacctcccttgggagatcaatcccctgtcctcctgctctttgctccgtgagaaagatccacctacgacctcaggtcctcagaccgaccagcccaagaaacaaacatctcaccaatttcaaatccggtaagcggcctctttttactctcttctccaacctccctcactatccctcaacctctttctcctttcaatcttggtgccacacttcaatctctcccttctcttaatttcaattcctttcattttctggtggagacaaaagagacatgttttatctgtgaacccaaaactccggcaccggtcacggacttggaaggcagccttcccttggtgtttaatcattgcagggacgcctctctgattatacactcacgtttcaagggtgtcagaccacgcagggacgccgccttggtccttcacccttagcggcaagtcccgctttcctggggcaggggcaagtacccctcagccccttctccttcacccttagtggcaagtcctgctttcctagggggcaagaagcccccaattgcttatttccgcaccccaacctcttatctctgtgccccaatcccttatttctgcaccctgacctcttatctctgtgccccaatcccttatttctgtgccccaaccccttctctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaaaatcgaaataattcttgtcgtaaaataggcaaacggtctgaggtgcctgacgtccaggcattcttttacacatcagtcccttcctaatctctgtgaccagtgcaactcgtcccaaatcttccttctttccctcccgcctgtcccctcagtaccaaccccaagcatcgctgagtctttctaatcttccttttctacagacccatctgacctctcccctcctccccaggctgctcctcgccaggctgagctaggtcccaattctttctcagcctctgctcctccaccctataatctttttatcacctcccctcctcacacctggtccggcttacagtttcgttccgtgactagccgactagccctccccctcctgcccagcaatttactcttaaaaaggtggctggagctaaaggaatagtcaaagttaatgctcctttttctttatcccaaatcggatagcgtttaggctttttttcatcaaatataaaaatccagcccagttcatggctcatttggcagcaaccctgagacactttacagccctagaccctaaaaggtcaaaaggccgtcttattctcaaaatacattttattacccaatctgctcccgacattaaataaaactccaaaaattaaatttcggccctcaaaccccacaacaggatttaattaacctcgccttcaaggtgtaccataatagaaaaaagttgcaattccttgcctccattgtgagacaaaccccagccacatctccagcacacaagaacttccaaaggcctgaaccgcagcagccaggcgttcctccagaacctcctcccacaggagcttgctacatgtgccggaaatctggccactgggccaaggaatgcccgcagcctgggattcctcctaagccgcgtcccatctgtgcgggaccccactgaaaatcggactgttcaactcacctggcagccactcccagagcccctggaactttggctcaaggctctctgactgactccttcccagatcttctcggcttagcagctgaagactgacactgcccgatcgcctcggaagccccctagaccatcacagacgccgagcttccggtaactctcacagtggaaggtaagcccgtccccttcttaatcaatacagaggctactcactccacattaccctcttttcaagggcccgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctggactacagctatatctcattgccacccttcttcccaagccaaagcctcctttgcgtccacctcttctatccccccaccttaacccacaagtataagacacctctactccctccttggcgaccgatcatgcaccccttaccatctcattaaaacctaatcacccttaccccactcaaggccaatatcccatcccgcagcacactttaaaaagattaaagcctgttatcactcacctgctacagcatggccttttaaagcctataaactctccttacagttcccccattttacctgtcctaaaaccagacaagtcttacaagttagttcaggatctgcaccttatcaaccaaattgttgtgcctataaaccccgtggtgccaaacccatatactctcctatcctcaatacctgcctctacaacccattattctgttctagatctcaaacatgctttctttactattcctttgcacccttaatcccaggctctcttcgctttcccttggactgaccctgacatccatcaagctcagcaaattacctaggctgtactgccgcaaagcttcacagacagcccccattacttcaatcaagcccaaatttcttcctcatctgttacctatctcggcataattctcataaaaacacacgtgctctccctgccgatcgtgtccgactgatctctcaaacccaagcaccttctacaaaacaactcctttccttcctaggcatggttagcgcggtcagaatttttacacaagagccaggaccacaccctgtagcctttctctccaaacaacttgaccttactgttttagcctagccctcatgtctgcgtgcagtggctgccgctgctttaatacttttagaggccctcaaaataagtagaggcctttcctacagggtctgagaaggccaccgcagtcatctcttccgttctgtcagacataattcctcagtttagccttcccacctctatacagtctgataacagaccagcctttattagtcaaatcagccaagcagtttttcaggctcttggtattcagtgaaacctttatatcccttatggtcctccatcttcaagaaaagtagaatggactaaaggtcttttaaaaacacacctcaccaagctcagccaccaacttaaaaaggactggacaatacttttaccacattcccttctcagaattcaggcctgtcctcggaatgctacagggtacagcccatttaaggtccataacaccccccaaaaaattttcgccgccccaacacttcaacactattttgttttatttttcttattaatataagaaggcaggaatatcaggcctctgagcccaagccaagccatcgcatcccctgtgacttgcacgtatacgcccagatggcctgaagtaactgaagaatcacagaagaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagtctgtttggtgctctcttcacacggatgcgcaagaaa

SEQ ID NO: 461 - DNA, 1022 bp, Homo sapiens
taggtagctagtcagacatgagcaggccaggagagggcccaatcccacccccaccaggaatgtcgggtgactatcaggtggtggtcaggtggttgttaactgtctctctaaaaaaataattggtcacacccagtgccagggaaaggtagtctcccaatagatagaaaaaacctgaagttggtgatcagcgacttcctactaatatctcaggagccgggtaagtgggctcacatgtgtgcaccaagacgaaaactggcggagtttaactggtatgtgaccttatacgaagacttgactggtaaaggaagaacatctcaagtgagcatgtgtacaagtcccataaatgcactgtgcatgctcacctccaagagctggcaggccactgcacatgcagacagcccaccccaagggaagaatcagagagaagggatgcaaggccccagaagtgtgccaacatataaaaccctaggtcaaaggtcaaagcatgcacttgatctctcaagttgcccgcttggccccctcttccaagtgtactttacttcctttcattcctgccctaaaactttttaataaactctcactcctgctctaaaacttgcctcagttctctcttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacctcagttctcactctgccttatgcccccctcagctgaattctttcttctgaggaggcaggaattgaggttgctacagatccatacagatt

SEQ ID NO: 462 - DNA, 968 bp, Homo sapiens
gtggggaaaagaaagagagatgagactgttactgtgtctgcatagaaagaagtagacataagagactccattttgttctgtactaagagaaattcttctgccttgagatgctgttaatctgtaaggctagccccaaccctgtgctcgcagagacatgtgctgtgttgactcaaggtttaatggatttagggctatgcaggatgtgctttgttaaaaaagtgcttgaacgcagtatgcttgttaaaagtcatcaccattctctaatctcaggtacctagggacacaatacactgtggaaggctgcagggacctctgcttaggaaagccaggtattgtccaatgtttctccccatgtgatagcctgagatatggcctcatgggaagggaaagacctgaccgtcccccatcccgacacccataaaaggtctgtgctgaggaggattagtgaaagaggaaggcttctttgcagttgagataagaggaaggcatctgtctcctgatcgtccctgggcaatggaatgtctcggtgtaaaacccgattgtatgttctgtttactgagataggagaaaatcgccttagggctggaggtgagacatgctagtggcaatactgctctttaatgcaccaagatgttcgtatacgtgcacatcaaggcacagtacctttccttaaacttatttatgacacagagacctttgttcacatgttttcctgctgaccctctccccactattaccctattgtcctgctacatacccccctctgagatggtagagataatgatcaataaatactgagggaactcagagaccagtgccagtgtgggtcctccatatgctgagcgccagtcccctaggcccacttttctttctctatactttgtctctgtgtcttctttcttttctcagtctctcatcccacttgacgagaaatgcccacaggtgtggaggggcaggaaaccccttca

SEQ ID NO: 463 - DNA, 295 bp, Homo sapiens
gagaagtaatgcaagactccagaagtatgccaatgtatgaaaaccccaagtctagaggtcaaactaggcacttgtctttcaagttgcttgcttggccttcttccaagtgtactttccttcctttcattcttgctctaaagcttttttgtaaactacctctcctgctctaaaacttgcctcagtctctccttctgccttatgtccctcaaattctttcttctgtggagtgtggggggcaagaattgaggatgctgtagacccgtacaaatacggaattgccatcgctaacactttg

SEQ ID NO: 464 - DNA, 221 bp, Homo sapiens
ggaggtggctagtcaggcttgagcatggcaggagaggtctcccccgaccccaccaggaatgtcaggcgaccatcaggtgatggtcaggcagttgtcacactctctctaaaataataactggtcacagccagtgccagggaaaggcagtctcccaataaacagaaacaccggaaactggtgatcacagcttcccagtaagctctcaggagttgcgtgagtag

SEQ ID NO: 465 - DNA, 1077 bp, Homo sapiens
cccttattttgctctgacattcttctaaatctaataacctgatatgcttcctctagccttcaggccatcaagctccagatgatcctcagtgagggttaacttcctctcaatattcaagagtaacccttctacagacccccagactgcccattagtgagacatgacagaggcaaaatcttgtccctgtctcccttggacctggctggatactgctttcaccaacccatggagccaccctcctgccctgacatctagcaaagaggccaagatccacagaacaaccaccaccatcaccccgctggaagcaggaagcagttacagaagactgaggttcatgcattttcttcaaataattgtgatcttggtctcttgggtgggagaatattacagtggctagtcaggcatgaacagggcaggggagggctgcctcgcatacatcaggaatgtcaggcagccatcaggtgattgttaggcagttgttaattgtctctctaaaataatatttggtccctgctggcaccagggagaggcagtctcccaatagatagaaataacctgacactggtgattagcagcttcccaataagatctcaggcattaggaaagtgggctcaagcatgtgcattaagaggcaaaatagcagagtttaactggtatatgaccatccagggacattcaactgctaagggaagaatgcctcaagtgagcatgcatacaactccactaaacatactgtgcatgcttacctcccacatgctagcaggccagtgtgcatgcagacagcccacctgaagggaagaatcaagggagaagggatgcaagactctggaagtatgccagcatataaaaccccaagtcaaaggtcaaacagggcacttgatctcttaagtcacctgcttggccctctttcaactgtactttatttcctttcatttctgctctaaagcttcttaataaactttcactcctgctctaaaacttgcctgggcctctccttctaacttctgcccctcagtcaaattctttcttctgaggaggcaagaattgaggttgctgcagacccatatagatttgcca

SEQ ID NO: 466 - DNA, 430 bp, Homo sapiens
gtcagacctctgagcccaagctaagccatcatatcccctgtgacctgcacgtatacatccagatggcctgaagcaagtgaagaatcacaaaagaagtgaaaatggccagttcctgccttaactgatgacattccaccattgtgatttgtttctgccccaccttaactgagcgattaaccttgtgaaattccttcccctggctcagaagctccctgactgagcaccttgtgaccctgggccctgccctccggagaacaactccctttgactgtaattttccactacctacccaaatcctataaaacggccccacccctaatctcccttcgctgactcttttcggactcagcccgcctgcacccaggtgattaaaaagctttattgctcatacaaagtctgtttggtggtctcttcacacgaacgcgcgtga

SEQ ID NO: 467 - DNA, 708 bp, Homo sapiens
gcaggcagtcaggcagacatgagcacagcaggagaggacacccccactccaaacccagcaatgtcaggcagccagcaggtgatgggcaggcgggtggctgttaagctgtctctctaaaatataattggtcacagccagtgccagggaaaggcagtttccccatagacaggaaaaacctgaaactggtgatcagcagcttcccaataagacctcaggagttgggtgagtgggctcaagcatgcaccctaagaggcaaaatggctgagtttcactggtctatgaccttcctctaggaaaacttgactggtaagggaagaacacctcaagtgagcatgcatacaatttcaggaaacacactgtgcatgcggcccctcccagatgctggaaggccactgtgcatgtggacagcccaccccatgggaagaatcaggggagaagggatgcaaccctccggaagcaggccaacctataaaaccccaagtccaaggtcaaactgcacttgatctctgaagtcgctgtgtggtcctcttccaagtgtactttacttcctttcattcctgctgtaaagcttttgaataaactttcattcctgctctaaaacttgcctcaatctcttcctgtgccttatgctccttggtagaattatttcttccgaggagacaagaattgaggttgctgtagactcatgtggatttgctgctgctaaaa

SEQ ID NO: 468 - DNA, 547 bp, Homo sapiens
acagtaggcagctagtcaggcatgagcagggcagggagagggccccaccccaccacaccaggaatgtcagctgaccatcaggcgatggtcagccagttgttacactgtctctctagaatgataattgtttgcagcccgtgccagggaaaggcagtttcccaagagattagaaacacctgaagctggtgatcagcagcttcctgataagatctctgtagttgggtgagtgggctccagcaagtgtattaagaggcaaaatggcagagatcaactggtgtatgacctcccagggacattctgcgggtaaagggaaagaagacctcaagtgagctccactcaacactctgtgcatgctcacctcctaagtgctagcaggccactgtgcatgtgagcagctggccccaagggaagaatcagggaagaagggaagcaagaccccagaagtataccaactcataaaaccccaagtcaaaaggtcaagccacgcatttaattttcaacttgaccacttggccctcttccaagtgtatgtgctttctttacattc

SEQ ID NO: 469 - DNA, 5683 bp, Homo sapiens
gtcaggcctctgagcccaagctaagccatcatatcccctgtgacccgcacatacacatccagatggctggttcctgccttaagtgatgacattccaccacaaaagaagtgaaaatggcctgttcctgccttaactgatgacattgtcttgtgaaattccttctcctggctcatcctggctcaaaacctcccccactgagtaccttgtgacccccactctgcccaccagagaacaactccccctttgactgtaattttcctttacctacccaaatcctataaaacagccccaccccatctcccttcactgactctcttttcagactcagcccccctgcacccaggtgaaataaacagccatgttgctcacataaagcctgtttggtggtctcttcacacggatgcgcatgaaatttggtgcagtgactgggatcgggggacctcccttgggagatcaatcccatgtcctccagttctttgctctgtgaaaaagatccacctacaacctcaggtcctcagacccaccagctcaaggaacatctcaccaattttaaattgggcaagcagcctcttcttactctcttctccaacctctctcactgtccctcaaccactttctcctttccactcttcaatctctcccttctcttaatttcaattcctttcattttctggtagagacaaaggagacacattttatctgtggacccaaaactccagtgcaggtcacggactgggaaggcagccttcccttggtgtttaatcattgcagggaagcctctctgattattcacccacgtttcaaaggtgtcagaccatgcagggacacctgccttggtccttcacccttagcggcaagtcctgcttttctgtgggaggggaaagtaccccaaccacttttctccatgtctctaccccttctccacctttctgggggacaagaaacccccaaccccttttccttcacccttagtggcaagacccacttttcttggggaggggcaagtaccacatcttatctctgcacccgaatcccttatatccatgccctgacctcttatctctgtgccccaatcccttatttctacaacctgacctcttatatctctgcaccccaatcccttatttccatgcctggacctcgtatctctgtgccctgacccctttcccacttttctggaggggaagaacccccaaaccccttccctccatgtctctactctctcttctctctgggcttgcttcctacactatgggcaaccttccaccctcctttcctccttcttctcccttagcctgtgtttttaagaacttaaaacctcttcaactctcacctgacctaaaatctaagcatcttattttcttctgcaatgccgcttgaccccaatacaaactcaacaatagttccaaatagccagaaaatggcactttcaatttttccatcctgcaagatctaaataattcttgtcataaaataggcaaacggtctgaggtgcctgacatccaggcattcttttccacattggcccctccctagtctctgtgcccaaagcaactcatcccaaatcttcctcctttccctcctgcctgtcccctcagtcccaaacccaagcattgctgagtctttctaatcttcctgttctacagacccatctgacctctcccctccttcccaggctgctcctcgccaggctgagctaagtcccaattcttccgcagcccccgctcctccaccctgtaatcttcttatcacctcccctcctcacacccggtcccgcttacagtttcattccgtgactagccctccccaacctgcccagcaatttactcttaaaagggtggctggagctaaagacatagtcaaggttaatgctcctttttctttatcccaaatcagatagcgtttagcctctttttcatcaaatataaaaatccagcccagttcatggcttgttcggcagcaaccctgagaggctttacagccctagaccctaaaaagtcaaaaggccgtcttattctcaatatacattttatttcccaatctgctccctacattaaataaaactccaaaaattaaattctggccctcaaaccccacaaaagatttaattaaccttaccttcaaggtgtaccataatagaaaaaagttgtaattccttacctccactgtgagacaaaccccagccacatctccagcacagaagaacttccaaacacctgaaccgcagcggccaggtgttcctccagaacctcctcccccaggagcttgccacaagtgccagaaatctggccaccaggccaaggaatgcctgcaccccaggattcctcctaagctgcgtcccatctgtgcgggaccccactggaaatcggactgttcaactcacctggcagccactcccagagcccctggaactctggcccaagcctctctgactgactccttctcagcttagcggctgaagacagatgctgcccgattgcctcggaagccctgtagaccatcatggaccccgagctttaggtaactctcacagtggagggtaagtccgtccccttcttaatcaatacggaggctacccactccacattaccttcttttcaaaggcctgtttcccttgcctccataactgttgtgggtattcacggccaggcttctaaacctcttaaaactcccgaactctggtgccaacttagacaatactcttttaagcactccttttagttatccccacctgcccagttcccttattaggctgagacactttaactaaattatctgcttccctgactattcctgggctacagccaaacctcattgctgacttttcccccagttcaaagcctccttcacatcctcctcttgtatctccccaccttaacccacaagtataggatacctctactccctccttggtgaccgatcatgcacctcttaccatctcattaaaacctaatcacccttactccactcaacgccaatatcccatcccacagcatgctttgaaaggattaaagcctgttatcactcacctgctacagcatggccttttaaagctccttacagttgccccattttacctgtcctaaaaccagacaagccttacaagttagttcaggatctgcactctatcaaccaaattgttttgcctatccaccctgtggtgccaaacacatatactctcctatcctcgatacctccctccacaatccattattttgttctggatctcaaacatgctttctttactattcctttgcacccatcatcccagcctctcttcgctttcacttggactgaccctgacacccatcaggctcagcaaattacctgggctgtactgctgcaaggcttcacagacagcccccattacttcagtcaagcccaaatttcttcctcatctgttacctacctcagcataattctcataaaaacacacgtgctctccctgctgatcatgtccgattaatctcccaaacctcaatcccttacaaaacaacaaccctttccttcctaggcatggttagggcggtcagaattcttacacaagagccaggactgcaccctgtagcctttctgtccaaacaacttgaccttattgttttagccaagacatcatatctccgtgcagcggctgctgatgccctaatacttttagaggccctcaaaatcacaaactatgctcaacttactctctacatttctcataacttccaaaatctattttcttcctcacagctgatgcatatactttctgctccccggctccttcagctgtactcactctttgttaagtcccacaattaccattgttcctggcccagacttcagtccggcctcccacattattcctgataccgcacctgacccccatgacagtatctctctgatccacctgacattcaccccatttccccatatttccttctttcctgttcctcacctgatcaagcttgatttattgatggcagttccaccaggcctaatcgccacacaccagcaaaggcaggctatgctatagtacaacccactagcccacctcttagaacctctcattttctttccatcgtggaaatctatcctcaaggaaataacttctcagtgttccatctgctattctactactcctcagggattattcaggcccttccctacacatcaagctcgaggatttgcccccatccaggactggcaaattagctttactcaacatgccccgagtcagataactaaaatacctcttggtctaggtagacactttcactggataggtacaggcctttcctacagggtctgagaaggccaccgcagtcatttcttcccttctgtcagacataattcctcagtttagccttcccacctctatacagtctgataacagaccagtctttattagtcaaatcagccaagcagtttttcaggctcttagtattcagtgaaacctttatatcccttacagtcctcagtcttcaggaaaagtagaatggactaaaggtattttaaaaacacacctcaccaagctcagccaccaacttcaaaagcactggacaatacttttaccactttcccttctcagaagtcagacctgtcctcagaatgctacaaaatacagcccatttgagctcctgtacagatgctcctttttattaggccccagtctcattccagacaccagaccaagttagactgtgcccccaaaaaacttgtcatccctactatctgctgtctgtcatactcctattcaccgttctcaactactcatacatgccctgctcttgtttacactgccagtttacactgtttctccaagccatcacagctgatatctcctggtgctatccccaaactgccactcttaactcttgaagtaaataaagaatctttgctggcaggactatgctgaatctccttaggcactctctaatcagatgtcctagatcctcccaattcttagacctttaatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacacggtccctaatcctgctcgaagcagccctgagaaacatcgcccattatctctccataccatcccccaaaattttcgctgtcccaacactttaccactatttcattttatttttcttattaatataagaagacaggaacgtcaggcctctgagcccaagctaagccatcatatcccctgtgacctgcacatatacatccagatggccggttcctgccttaactgatgatattccaccacaaaagaagtgaaaatggcctattcccaccttaactgatgacatttatcttgtgaaattccttctcctggctcatcctggctcaaaacctcccccactgagtaccttgtgacccccactctgcccgccagagaacaacccccctttgactgtaattttcctttacctatccaaatcctataaaatggccccacccctatctccctgcactgactctcttctcagactcagcctgcctgcacccaggtgaaataaacagccatgctgctcacataaagcctgtttggtggtctcttcacgtggatgtgcattaaa

SEQ ID NO: 470 - DNA, 3746 bp, Homo sapiens
gtcaggcctctgagcccaagctaagccatcatatcccctgtgacctgcacatacacatccagatggccggttcctgccttaactgatgacattccaccacaaaagaagtgaaaatggcctgttcctgccttaactgatgacattatcttgtgaaattccttctcctggctcatcctggctcaaaagctcccctgctgagcaccttgtgacacccccacccactcctgcccgccagagaacaaccccctttgactgtaattttcctttacctacccaaatcttataaaacggcctcacccctatctccctttgctgactctcttttcggactcagcccgcctgcacccaggtgaaataaacagccttgttgctcacacaaagcctgtttggtggtttcttcacagggatgtgcatgaaatttggtgccatgattcagaccccactggaaatcggactgttcaactcacctggcagccactcccagagcccctggaactctggcccaaggctctctgactgactccttcccagatcttctcggcttagcagctgaagactgacattgcccgatcacctcggaagcctacaggaccatcacggatgctgtgagtaactctcacagtggacggtaagtccgtccccttcttaatcaatatggagactacccactccacattaccttcttttcaaaggcctgtttcccttgcctccataactgttgtaggtactgacggccaggcttctaaacctcttaaaactctccaactctggtgccaacttaggcaatacttttttaagccctcctttttagttatccccacctgcccagtccccttattcagctgagacactttaactaaattatctgcttccctcactattcctggactgcagccacatctcatcgccgcccttcttcccaatccaaagcctcctttccatcctcctcttgtatccccctaccttaacccagaagtatggaatacctctactccctccttggcgaccaatcatgcaccccttaccatctcattaaaacctaacacccttaccccgctcaatgccaatatcccatcctgcagcacactttaaaaagattaaagcctgttatcacttgcctgttacagcatggccttttaaagcctgtaaactctccttaaaattcccccattttacctgtccaaaaactggacaagtctcacaggttagttcaggatctgcgccttatcaactaaattgttttgcctatccactccatagcgccaagcccatatactctcttatcctcaatacctccctttacaatccattattctgttctggatctcaaacatgctttctttactattcctttgcacccttcaccacagcctctcttcactttcacttggactaaccctgacacccatcaggctctgcaaattacctaggctgtactgccacaaggcttcacagacagcccccattacttcagtcaagcccatatttcatcctcatctgttacctatctcagcataattctcataaaaacacaggtgctctccctgctgatcgtgttagactaatctcccaaacctcaatcccttctacaaaacaactcctttccttcctaggcatggttagtgcagtcagaattcttacacaagaactgagaccacaccctgtagcctttctgtccaaacaactttaccttactgctttagcctagccctcatgtctgcatgcagtggctgccactgctttaatagttttagaagccctaaaaatcacaaactatgctcaactcactctctacagttctcataacttccaaaatctattttcttcctcatacctgatgcatatactttctgcttcccagctccttcagctgtactcactctttgttgagtctcccacgattaccattgttcccagcacggacttcaatctggcctcccacattattctggataccacacctgaccctcgtgactgtatctctgtgatccacctgatgttcaccccatttccccatatttccttatttcctgttcctcacactgatcacatttagtttattgatggcagttccaccaggcctaatagccactcactagcaaaggcaggctatgctatagtacaagccactagcccacctcttagaacctctcatttcctttccatcgtagaaatctatcctcaaagaaataacttatcagtgttccatctgctattctactacttctcaaggattattcaggccccctcccttccctacacatcaagctcaaggatttgcccccacccaggactggcaaattgactttactcaacatgccccaagtcaggaaactaaaatacctcctagtctaagtagacagtttcactggataaatagaggcctttcccacaaagtctaagaaggccaccatggtcatttcttcccttctgccagacataattcctttgtttggccttcccacctctacacagtctgatagcagaccagcctttattagtcaaatcagccaagcattttttcaggctcttagtattcagtgaaacttgtatatcccttacagtcctcagtcttcaggaaaggtagaacggactaatagtcttttaaaaacacaccttaccaagctcagccaccaacttaaaaaggactagagaatacttttaccactttcccctctaagaattcaggcctgttctcagaatgctacaaggtgaacaggagcccatttgatctcctgtatagatgctctttttattaggccccagtctcatcccagacaccagatcaacttggactgtgccccaaaacttgtcatccctactattttctgtctaatcatactcctattcaccattctcaactactcatacatgccctgctcttgtttacactgccggtttacactgtttctccaagccatcacagctgatatctcctgctgctatccccaaaccgccactcttaactcttaaagtaaataaataatatttgcttgcaaggctatgctgaacctccttcagcactctctaattagatgtcctaagtcctcccaattcttagtcctttaatacctgtttttctccttctcttattccgtttagtttttcagttcatacaaaaccgtatccaggccatcagcaataattctacatgacaaatatttcttctaacaaccccacaatatcatcccttaccacaaaatcttccttcagcttaatctttcccactctaggttcccacaccgcccctaatacccctcgaagcaaccctgagaaacaacgtccattatctctccataccacacccaaaaatttttcgccgtcccaacactttaccactatttcgttttatttttcttattaattataagaagacaggaatgtcaggcctctgagctcaagctaagccatcatatcccccgtgacctgcacatacatatccagatggctggttcctgccttaactgatgacattatcttgtgaaattccttctcctggctcatcctggctcaaaagctcccctgctgagcaccttgtgaccccctccccgcccctgcccgccagagaacaaccccctgtgactgtaattttcctttacctacccaaatcttataaaatggcctcacccctatctccctttgctgactcttttcggactcagcccgcctgcacccaggtgaaataaacagccttgttgctcacacaaagcctgtttggtggtctcttcacatagccacgcgtgaaa

SEQ ID NO: 471 - DNA, 6489 bp, Homo sapiens
gtcaggtctctgagcccaagataagccatcatatcccctgtgacctgcacatatacatccagatggcctgaagtaactgaagaatcacaaaagaagtgaaaatggcctgttcctgccttaactgatgacactaccttgtgaaattccttctcccggctcatcctggctcaaagtctcccccactgagcaccttgtgacccccacccctgccagccagagaacaaccccctttgacagtaattttccactacctacccaaatcctataaaacggccccaccccatctcccttcactgactctcttttcggatcagcctgcctgcaccaaggtgaaataaacagccttgttgctcacacaaagcctgtttggtggtctcttcacacggacgtgagtgaaatttggtgctgtgactcggatcaggggacctccctcgggagatcaatcctctgtcctcctgctctttactccatgagagagatccacctacgacctcgggtcctcagaccaaccagcccaaggaacatctcaccaattttaaatcgggtaagcggcctctttttattctcttctcctccctctctcactatccctcaacctctttctcctttcagtcttggtgccatctttcaatctctcccttctcttaatttcagttcctttccttttctggtagagacaggagatgcgttttatctgtgaacccaaaactccggcaccggtcacagacttgggaagacagtcttcccttggtgtttaatcatgcagggatgcctgctttattattcacccatgtttcagaggtgtctgatcacacggggatgcctgccttggtccttcacccatagcagcaagcaccacttttctgggggcaagcaccccccaccccttctctctgtgtctctaccccttttccgcttttcttaggggcaagcactccccaatccttctctccatgtctccactctctcttttctctgggcttgcctccttcactacgggcaacctaccaccctccattcctccctcttctcccttagcctgtgttctcaaaaacttaaaacctcctcaactcacacctgacctaaaacctaaatgccttattttcttctgcaacaccgcttggccccaatacaaacttgacaatggctctaaatggccagaaaacggcactttcaatttcaccatcctacaagacctagataatttttgtcgaaaaatgggcaaatggtctgagatgccttacatccaggcatttttcacacttcattccctccctagtctctgtacccaatgcgattcctcccaaatcttccttctttccctcctgcctgtcccctcagtcccaaccccaagtgtcgctgagtctttccaatcttccttttctacagatcatccgacctctcccctcctccccaggctgctcatcgccaggctgagccaggtccaattcttcctcagcctccgctcctccaccctataatccttcgatcacctcccatcctcacacccagtctgtcttacagtttggatccaagactagctcttctccagctgcccaacaatttcctcttagagagtggctggagctgaaggcacagtcagggtacatgtgcctttttctctttcagacctctctcagatcagtcagcactcagaccctactgaatatatacaggaattccaatatctaactctgtcctacaatttaacctggagtgacttaaatgtcatcctaacttctaccctctccccagattcacaggaaattttttctctggcccaatctcacactgacaaccgctggctccatgaaccagacctccaggaaggcattagcgcagttccccgagaggatccccaatggaactatcaggcagattccccaagtatagctaggtgagattacatggtttcctgcctagttgaaggatttaaaaaggcagcttacaaagctgttaattatgacaagcttaaagaaactacccaaggtaaagacgaaaactcagcccagttcatggctcatttggcagcaaccctgagatgctttacagccctagaccttgaaggcccaggctttctgactgtctcattctaaatatgcattttatcacccagtcagctcctgacattagaaaaaaacttcaaaaattagaatccggccctcaaaccccacaacaggaattaatcaacctcaccttcaagttgtacaataatagagaaaagttacaattacttgcctccaccgtgagacaaaatcccagctacatctccagcacacaagaacttccaaacacctaaaccgcagcggccaggcattgctccaggaccccctccccaaggaacttgcttcaagtgctggaaatctggccactgggccaaggaatgccctcagcctgggattcctcctaagccgtgtcccatctgtgcgggaccccactggaaatcggactttctaactcgcctggcagccactcccagagcccctggaactctggcccaaggctctctgactgactccttcccagatcttctcggcttagcggctgaaggctgacgctgcccaattgcctcagaagcttcctggaccatcacagatgctttgggtaactcttacagtggaggttaagtccgtccccttcttcttcttctttttttttttttttgttttgagatgcagtcttgctctgtcgcccaggctggagtgcagtggcacgatctcagctcactgcaagctccgcctcccaggttcacgccactctcctgcctcagcctcctgagtagctgggactacaggcacctgcctctgcgcccggctaattttttttgtatttttagtagagacggggtttcactgtggtctcgatctcctgacctcgtgatccacccgcctcagcctcccaaagtgctgggattataggtgtgagccaccgcacccggccccttccccttcttaataaatagggaggctaccaactccacattaccttcttttcaaaggcctgtttcctttgcctccataactgttgcgggtattgacagccaagcttcaaaaccccttaaaactcccccactctggtgccaacttggacaacattcttttatgaagtcttttttagttatccccacctgcccagttccttattaggccaagacattttaactaaattatctgcttccctgactattcctaggctagagccacacctcattgccacccttcttcccaacccaaagcctcctttgcatcttcctctcgtatccccccaccttaacccacaagtatgggacacctccactccctccctggcaaccgatcacatgcccattactatcccattaaaacctaatcacccttaccccgctcaatgccagtatcccatcccacaataggctttaaagggattgaagcctgttatcattcgcctgttacaccatggccttttagagcctaaaatctctccttacaattcccccattttacctgtcctaaaaccagaaaagccttaccggttagttcaggatctgcgccttatcaaccaaattgttttacctatccaccccagggtgccaaacccatatactctcctctatcctcaatacctccctccacaacccattctgtcctagataaacctagctgaccccataaatcctaaatcctttccccactcccctttccattccttaaaaaacagccctaaaagctgctcccacactagctctccctaaatcatcccaaccttttcattacacacagccgaagtgcagggctgtgtggtcagagttcttagacaagagctgggactgcaccctgtagcctttttatccaaacaacttgaccttactgttttagcctagccctcatgtctgcatgtggcggctgccgctgccttaatacttttagaggccctcaaaatcacaaactatgctcaactcactctctacagttctcataacttccaaaatctattttcttcctcccacctgatgcatatactttctactccccagcttcttcagctatactcactctttgttgaatctcccacaattaccattgttccaggcccggacttcaatccggcctcccacattattccagataccacacctgacccccatgactatatctctctggtccacctgacgttcaccccatttccccacatttccttctttactgtttctcaccctgatcacatttggtttattgatggcagctccaccaggcctaatcgccactcaccggcaaaggcaggctatgctatagtatcttccacacctatcattgaggctactgctctgcccccctccattacctctcaacaagccaaactcattgccttaactcgagccctcgcccttgcaaaaggactatgtgtcaatatttatactgactctaaatatgccttccatattctgcaccaccatgctgttatatgggcagaaagaaatttcctcactatgcatgggtcctccatcattaatgcctctttaataaaaactcttctcaaagccactttacttccaaaggaagctggagtcattcactgcaagagccatcaaaaggcatcagatcccatcgctcaagacaatgcttatgctgataaggtagctaaaaaagcagctagctttccaacttctatccctcacggcagtttttctccttctcatctggccactcccacctactcccccactgaaacttccacctatcaatctcttcccacataaggcaaatggttcttgcaccaaggaaaatatctcctcgcagcctcacaggccccttctattctgtcatcatttcataacctcttccatgtaggttacaagctgctagcccacctcttagaacctctcatttcctttccatcgtggaaatctatccttaaggaaatcacttctcagtgttccatctgctattctactactcctcagggatttttcaggcctccctccattccctacacatcaagctcggggatttgcccctgcccaggactggcaaattgactttactcacatgccttgggtcaggaaactaaaatacctctggtctgggtagacactatcactggataggtagaggcatttcccacagggcctcagaaggccaccgtggtcatttcttcccttttgtcagacataattcctcggtttggccttcccacctctatacagtccaataatgggccggcctttattagtcaaatcacccaagcagtttctcaggctgttggtattcagtgaaaccttcacaccccttacggtcctcaatcttcaggaaaggtagaatggactaatggtcttttaaaaacacacctcaccaagctcagccaccaacttaaaaaggactggacaatacttttaccacttgcccttctcaaaattcgggcctgtccttggaatgctacagggtacagcccatttgagctcctgtatggacactcctttttattaggccccagtcttattccagacaccagcccaacttggactgcaccccaaaaacttgtcatctctactatcttctgtctagtcatactcctattcaccgtactcaactactcataaatgccctactcttgtttacactgctggtttacactgtttctccaggccatcacagctgatatctcctggtgctatccccaaacagccactcttaactccctcttaaagtaaataaataatctttgctggcagggccatgctgaacctccttgggcactctctaattggatggcctgggccctcccaattcttagtcctttaatatctgtttttctccttctcttatttggaccttgtgtcttccatttagtctctcaattcatacaaaacagcatccaggccatcaccaatcattctatatgacaaatgctccttttaacaaccccacaatattgcccttaccacaaaatcttccttcagcttaatctctcccactctgggttcccacgtcacccctaataccgcttgaagcagccccaagaaacattgcccattatctctccatagcacccccaaaaattttcgctgccccaacactttaccactattttgttttatttttcttattaatataagaagacaggaatgtcatgcctctgagcccaagctaagccatcatatcccctgtgacctgcaggtatacatccagatggcctgaagtaactgaagaatcacaaaagaagtgagaatggcctgttcctgccttaactgatgacactgccttgtgaaattccttctggctcaaaatctcccccattgagcaccttatgacccccacccctaccagccagagaacaaccccctttgactgtaattttccattacctacccaaatcctataaaatggccccacccctatctcccttcactgactctcttttcggactcagcccacctgcacccaggtgaaataaacagccttgttgctcacacaaagcctgttttgtggtctcttcacatggacatgagtgaaa

SEQ ID NO: 472 - DNA, 995 bp, Homo sapiens
aaggaaaggtgatgggaagaatgtggggaaaagaaagagagatcagattattactgtgtctgtgtagaaagaagtagacataagagactccattttgttctgtactaagaaaaattcttctgccttgagatgctgttaatctgtaactctacccccaaccctgttctccctgagacatgtgctgtgtccactcagggttaaatggattaagggctgtgcaggatgttcgttgttaaacaaatgcttgaaggcagcatgcttgttaagagtcatcaccactccctaatctcaagtacccagagacacaaaacactgcggaaggccacagggacctctgccgaggaaagccaggtattgtccaaggtttctccccatgtgatagtctgaaatatggcctcgtgggaagggaaacacctgactgtcccccagcctgacaccagtaaagggtctgtgctgaggagggttagtaaaagaggaaggaacgcctctttgcagttgagataagaggaaggcatctgtctcctgctcctccctgggcaatggaatgtctcggtgtaaagtccaattgtatattccatctactgagataggggaaaactgccttagggctggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctctgggaaatgcccgataatgatcaataaatagtaagggaactcagaggccggtgtcagcgtgggtcctccgtatgctgaatgctggtctcctgggcccatttttctttctctatactttgcctctgcatctgtttattttccaagtctctctttccacctaatgagaaacgcccacaggtgtggaggggcaacccatcccttca

SEQ ID NO: 473 - DNA, 474 bp, Homo sapiens
cccacacaccaaaaatatcaggtgaccatcgtgatggtcaggcagttgtcaacctgtctctctaaaataataattggtcacagccagcgccagggaagcacagtctcctaatagatagaaaacaccgaaacaggtgatcggcagcttcctgataagatctcaggagttgggcaagtggcctcaggcatgtacatgcagacggcccaccccaacgagaaacagggagaattaacgagaccctggaagtgtgccaatgtataaaacccctagccataaggtcaaactgcacactgatctctcaagtcacccgcttgggcctcttctaagtggacttgacttcctttcattcctcctctaaagctttttaaacaaactttcactcctgctctaaaacttgccttcactcctgctcataaacctgccttacgcccctcactcaaattctttcttctgaggaggcaggaattgaggttg

SEQ ID NO: 474 - DNA, 903 bp, Homo sapiens
gtggggaaaagaaagagagatcatactgttactgtgtctatgtagaaagaagtagacataagagactccatttttttctgtactaagaaaaattcttctccttgagatgctgtcaatctgcaaccctaccccgaaccctgtgctcacagaaaacatgtgctgtgtcgactcaaggtttaatggatttagggctatgcaggatgtgctttgttaaaccaatgcttgaaggcagcatgcttgttaaaagtcatcaccactccctaatctcaagtacccagggacacaaaacactgcagaagtccgcagggacctctgcctaggaaagccaggtattgtccaaggtttctcccgatgtgatagtctgaaatatggcctcatgggaagggaaagacctgaccgtcccccagcccgacacctgtaaagggtctgtgctgaggaggattagtaaaacaggaaggcctctttgcagttgataagaggaaagcatctgtctcctgctcatccctggccaatggaatgtctcggtgtaaaacccaattgtatattccatctactgagataggagaaaaccaccttagggctggaggtgagacatgctggtggcaatactgctctttaaggcattgagatgtttatgtatatgcacatgaaaagcacagcacttttttctttaccttgtttatgatgcagaggcacttgttcacatgttttcctgctgaccctctctccactattaccctattgtcctgccacattcccctctctgagatggtagagctaatgatcaataaatactgagggaactcagagaccggtgccggcgctggtcctccgtaagctgagctccagtcccctgggcccgcttttctttctgtatactttgtctgtgtctctttcttttcc

SEQ ID NO: 475 - DNA, 4335 bp, Homo sapiens
gtcaggtctctgagcccaagccaagccatcccatcccctgtgacttgcacgtatacgccgagatggcctgaagtaactgaagaatcacaaaagaagtgaaaggccctgccccgccttaactgatgacattccaccattgtgatttgttcctgccccaccttaactgagtgactaaccctttgaatttccttctcctggctcagaagctcccccaccgagcaccttgtgacccccgcccctgcccaccagagaacaaccccctttgactgtaattttcctttaccttcccaaatcctataaaacggccccacccttatctcccttcactgactctcttttcggactcagcccaaccgcatccaggtgaaataaacagctttattgctcacacaaagcctgtttggtggtctcttcacatggacacacatgaaatttggtgccgtgacttggatcgggggacctcccttgggagatcaatcccccgtcctcctgctctttgctccgtgagaaagatccatctacgacctcaggtcctcagaccgaccagcccaagaaacatctcaccaatttcaaatccggtaagcggcctctttttactctcttctccaacttccttcactatccctcaacctctttctcctttcaatcttgacaccacacttcaatctctcccttctcttaatttcaattcctttcattttcggatagagacaaaggagacatgttttatccgtggacccaaaactccggtgccggtcacggactgggaaggcagccttcccttggtgtttaatcattgcagggatgcctctctgattattcacccacatttcaaaggtgtcagaccacgcagggatgcctgccttggtccttcacccttagccgcaagtcccgcttttctgggggaggggcaagtaccccaaccccttctctccatgtctctaccccttctctgcttttctgggggaggggcaagtacccctcaaccccttctccttcacccttagtggcaagtcccgcttttctagggggcaagaacccccaatcccttatttccgtgccccaaccctttctctgcttttctggagggcaagaaacccccatcacttctccgtgtctctactcttttctctgggcttgcctccttcactatggactagcttccaccttccattcctccttcttctcccttagcctgtattcttaagaacttaaaacctcttcaactctcacctgacctaaaatctaagcgtcttttttcttctgcaatgccgcttgaccccagtacaaactcgacagtagttacaaattgccagaaaaacggcactttcaatttttccatcctacaagacctaaataattcttgtcgtaaaacgggcaaatggtctgaggtgcctgatgtccaggcattcttttacacatcagtcccttcctagtctctgcccaatgcaattcatcccaaatcttccttctttccctcccgcctgtcccctcaggcccaaccccaagcgtcgctgagtctttctaatcttccttttctacagacccatctgacctctcccctcctcgccaggccgagctagttcccaattcttcctcagcctctgctcctccaccctataaactttttatcgcctcccctcctcacacctgatccggcttacagttttgttccatgactacccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcattcggcagcaaccctgagatgctttacagccctagaccctaaaaggtcaaaaggccatcttattctcaatatacattttattacccaatctgctcctgacattaaataaaactccaaaaattggaatctggccctcaaaccccataacaggacttaattaacctcactttcaaggtgtacagtaataaaacaaagttgcaattccttgcctccactgtgagacaaaccccagccacatctccagcacacaagaacttccaaacgcctgaacctcagtggccaggcattcctccagaacctcctcccccaggagcttgctacaagtgccagaaatctgaccaccaggccaagtaatgcccgcagcccaggattcctcctaagccgtgtcccatctgtgtgggaccccagtggaaatcggactgttcaactcacctggcagccactcccagagcccctggaactctggcccaaggctctctgactgactccttcttggcgtagcggctgaagactgatgctgcctgatcacctcagaagccccatagaccatcacggacgccgagctttaggtaactctcacagtggagggtaagtccgtccccttcttaatcaatatggaggctacccactccacattaccttcttttcaagggcctgtttcccttgcctccataactgttgtgggtattgacagccaggcttctaaacctcttaaaactccccaactctggtgccaacttagacaatactcttttatgcactcttttttagttatccccacctgcccagttcccttattaggccgagatattttaaccaaattatctgcttccctgactattcctggactacagccgcatctcattgctgcccttcttcccaatccaaagcctcctttgcatcctcttcttgtattcccccaccttaacccacaagtataagatacctctactccctccttggtgaccgatcatgcaccccttatcatctcattaaaacctaatcacccttaccccgctcagtgccaatatcccattacagcatgctttgaaaggattaaagcctgttatcactcgcctgctacagcatggccttttaaagcctataaactctccttacaattcccccattttacctgtcctaaaaccagacaagccttacaagttagctcaggatctatgccttatcaaccaaattattttgcctatccacctcatggtaccaaacccatatactctactatcctcaatacctccctccacaatccattattctgttctggatctcaaacatgctttctttactattcttttgcaccagtcatccaagcctctcttcgctttcacttggactgaccctgacacccatcaggctcagcaaattacctgggctgcactgccacaaggcttcacagacagaccccattacttcagtcaagcgcaaatttcatcctcatctgttacctatctcggcataattctcgtaaaaacacacatgctctccctgatgatcgtgtccgattaatctcccaaacctcaatcccttacaaaacaacaactcctttccttcctaggcatggttaatgtggtcagaattcttacacaagagccaggaccgcaccctgtagcctttctgtccaaacaacttgaccttactgttttagcctagccctcatgtccgcgtgcagcggctgccgctgctttagtacttttagaggccctcaaaatcacaaactatgctcaactcactctctacatttctcataacttccaaaatctattttcttcctcatacctgacgcatatactttctgctccctggctccttcagctgtactcactctttgttaagtcccacaattaccattgttcctggcccggacttcaatccagcctcccacattattccagacaccacacctgaccctcatgactgcatctctctgatccacctgatgttcatcccatttccccacatttccttcgtccctgtttctcaccctgatcacgcttgatttattgatggcagttccaccaggcctaatcaccacacaccagcaaaggcaggctatgctatagtacaagccactagcccgcctcttagaacctttcatttcctttccatcgtagaaatctatcctcaaggaaataacttcttagtgttccatctgctattccatctgctactcctcaaggattattcaggccccttccctacacaacaagctcgaggatttgcccccacccaggactggcaaattagctttactcaacataccccgagtcccaaaaactaaaatacctctttgtctaagtagacactttcactagataggtagaggcctttcctatagggtctgagaaggccactgcagtcatttcttcccttctgtcagacataattcctcagtttagccttcccacctctatacagtctgataaaagaccagcccttattagtcaaatcagtcaagcatttttttaggctcttagtatccagtg

SEQ ID NO: 476 - DNA, 4088 bp, Homo sapiens
tgctaaatgatttaagagccattaacgccataattcaacccatgggggcctctccaacccgccctctctggccctcatggccctctccagccatgatcctcaaagattggcctttaattataattgatctgaaggattgcttttttttaccattcctctggtgaagcaggattttgaaaaatttgcttatactataccagccataaataataaggaaccagccaccaggtttcagtggaaagtgttacctcaggaaatgttaaacagcccagctatttgtctgacttttgtaggtcaagctcttcaactagttagagacaagtttccagactgttatattgttcattatgtagatgatattctatgtgcttcagaaatgagagataaattaactgactgttacacatttctacaagcagaggttgccaacgcaggactgatgatagcatctgataaaattcaaacaacaactccttttcattatttagggatacaggtagaaaatagaaaaattaaaccacaaaaaatagaaataagaaaagatacattaaaaatattaaatgaggccgggcacggtggctcacacctgtaatcccagcactttgggaggccaaggtgggtggatcacgaggtcaggagatcgagaccatcctggctaacacggtgcaacaccagctctactaaaaatacaaaaaattagccgggcgcagtggcgggtgcctgtagtcccagctacttgggaggctgaggcaggagaatggcatgaacccgggaggcggagcttgcagtgagccgagatcgcaccactgcactccaaattatttgaagaaaattcgatcagcacaagtaaatagactagatcccttggctccactccaacttttgatttttgctactgcacattctccaacaggcatcattgttcaaaatacagatcttgtggagtggtcattccttcctcacagtacagttaagatttttacattgtacttggatcaaatggctacattaattggtcaggcaagattacgaataatctaattgtgtggaagtgacccagacaaatcattgttcctttaaacgaggaacagtttagacaagcctttatcaattctagtgcatggcagactggtcttgctgattttgtgggaattattgataatcattacccaaaaacaaacatcttccagtttttaaaactgactacttggattttacctaaaattaccagacataaacctttagaaaatgatctgactgtgtttattgatggttccagcaatggaaaagcagcttacactgggccaaaagaaggaggccttgaaactcaatatcattcggctcaaagagcagagttggttgccgtcattacagtgttacaagattttaatcagcctattaatattgtatcagattctgcatctgtagtacaggccacaagggatattgagacagccctaatcaaacatagcatggatgatcagttaaaccagccgttcaatttattacaacaaactgtgagaagaagaaatctcccattttatattactcatatttgagaacacactaatttaccagggcctttaactaaagcaaatgagcaagctgacttactggtatcatctgcattcacaaaagcacaagaacttcatgctttgagtcatgtaaatgcaacaggtttaaaaaataaatttaatatcacatggaaacaggcaaaaagtattgcacaacactgcacctggtgtcaagccctacacctgcccactcaggaggcaggagttaatcccagaggtctgcgtcctaatgcgttatggcaaatggatgtcacgcatgttccttcatttggaagattgtcatatgttcatgtaacagttgatacttattcacatttcatgtgggcaacctgacagacaggagaaagtacttcccatgttaaaagacatttatttttctttttttgctgtcataggagttccagaaaaaattaaaactgacaatggaccaggatactatagtaaagctttccaaaaattcttgaatcagtggaaaattgcacgtacaacaggaattccctataattcccaatgacaggccatagttgaaagaactaatagaacaccgaaaactcaattggttaaacaaagaaaagagggagacagtacggagtatatcactcttcagatgcaacttaacctagcactctatactttaaattttttaaacctttatagaaatcagactactacctctgcagaacaacatcttactggtaaaaagaacagcccacatgaaggaaaactaatttggtggaaagacaacaaaaataagacatgggaaatagggaaggtggtaacgtgagggagaggttttgcttgtgtttcaccaggagaaaatcagcttcctgtttggatacccactagacatttaaagttctacaatgaacccatcggagatgcaaagaaaaacgcctccgtggagacagagacaccgcaattgagcaccattgactcgccagatgaacagaatggtgatattaaaagaacaaatttttgaagcatcaaaagcccatttaaatttggtaccaggaactgaggcaattgcgggagttgctgatggcctcacaagtctctctctctctcttttttttagacggagtctcactttgtcgcccaggctggagtgcagtggcactatctcggctcactgcaagctccacctcccaggttcatgccattctcctgcctcagcctcctgagtagctgggactacaggcgcctgccaccacgcccagccaatttttttgtatttttttagtagagacagggtttcactctgttagccaggatggtctcaatctcctgacctcgtgatccacccaccttggcctcccaaagtgctgggattacaggcgtgagccaccgtgcccagccggcctcacaagtcttaaccctgtcacttgggttaaaaccctcggaagttccgctatcgtaaatttcgtgttaatgcttctgtctgttgtcagtctgcagctgtacccaacagctccgaagagacagcgaccatcgagaatgggccatgatgatgatggtggttttgtcaaaaagaaaagggggaaatgtgggggaaagagaggtcagactgttactgtgtctatgtagaaaaaggaagacataagaaactccattttgatctgtattaagaaaaattcttctgctttgacatgctgttaatctgtaaccttagccccaaccctgtactcacagaaacatgtgctgtgttaactcaaggtttgagggatttagggctatacagcatgtgctttgttaacaatgtgtttgcaggcagtatgcttggtaaaagtcatcgccattctccattctccattaaccagggacacagtgcactgcggaaagccgcagggacctctgcccaagaaagcctgcgtattgtccaggtctccccccactgagacagcctgagatatggcctcatgggaagggaaagacctgatcgtcccccaggctgacacccataaagggtctgtactgaggaggattagtgaaagaggaaggcctctttgcagttgagataagaggaaggcatctgtctcctgctcatccctgggaatggaatgtcttggtgtaaagcccaatcatacattctgtttactgagataggagaaaactgccccatggctggaggtgagacatgctggcggcaatactgctctttactgcactgagaggtttgtgtaaagtcagacataaacctggcctacgtgcacatccaggcacagcacctttccctaaacttatttatgacacagagtcctttgctcatgttttcctgctgaccctctgcccaccattaccctatagtcctgccatgtccccctcaccgagatagtagagctagtgatcaataaatactgaggaactcagagaccagcgtcggtgcagttcctcacttgctgagtgccggtcccctgggcccacttttcttcccttatactttgtctttgtgtcttatttgttttctcagtctctcatctccacctggtgagaaatacccgcaggtgtggaggggca

SEQ ID NO: 477 - DNA, 4462 bp, Homo sapiens
ccacaaaagaagtgaaaatggtcggttcctgccttaactgatgacattaccttgtgaaattccttctcctggacaatgaatctcagaagctcccccaccgagcaccttgtgacccctgcccctgcccaccagagaacaacccgctttggctgtaattttccactacctacccaaatcctataaaactgccccacccctaactctctttgctgacttcttttttaggctcagtcctcctgcacccgggtgattaagaagctttattgctcatacaaagcctgttcggtgatctcttcacacagacgcatgtgacatttggtgccgaagacctgggacaggaggaatcctttgggagaccagtcccctgtcctcgccctcactccatgaggaaattcccctataacctcaggtcctcagaccaaccagcccaaggaacatctcaccaatttcaaatcaggtaagcagtcttttcactctcttctccagcctctctcattaccctccaatctccctgtccttccaattccagttctttttcctctccagtagagacaaaggggacacattttatccacggacccaaaactccggcgccagtcacggactcaggaaagtcttcccttggtgtttaatcactgcagggacgcctgcctgattattcatccacatttcagaggtgtctgatcactgtggggacacctgccttgatccttcatcttggtggcaagtaccacctcccctgagtggcaagtaccacctcccctgggtggcaaggaccacctcactgccgtgtctctaccctctcttttctctgggcttgcctccttcactatgggcaatcttccaccctcctttcccccttcatctcccttagcctgtgttcttaaaaacctaaaaccccttcgactaacacctgacttaaaacctaaacgtcttattttcttctgcaatactgcttgaccccaatacaaactcaacaatggttccaaatggccagaaaatggcacttttgatttctccatcttgcaagacttggatgatttttgtcaaaaaatggacaaatggtctgaggtgcctgacgtccagacattcttctacatattggtcccaccctagtctctgctcctaatgtgacttgccccaaatcttccttctttctctcctgtcttttccttcagtctccaccccaagctctgagtcctttgaatcctccttttctacgaacacatctgacctctcccttcctccccaggctgctctttgccaggccgagccaggtcccaattcttcccagcctccactcccccactctataatccttctagcacctcccatcctcacatccagtccgcttatccgtgactaaccctcccccacctgcccaacaatttcctcttagagaggtggctggagctgtaggtatagtcaaggttaatgctcctttttctttagccaacctctcccaaatcaattagcatttaggctttttttcatcaaatataaaaacccagcccagttcatggcccatttggcaacaacccttagacgctttactgccctagaccccaaggggccagaaggccgtcttattctcaatatacattttattacccaatccactcccaacatttaaaaaaagctccaaaaattagattacagccctcaaaacccacaacaagacttaattaaccttgccttcaaggtgtacaataatagagaagacacagccaagaggcaccgtatttctgagttgcaattacttgcctctgctgtgagagaaaccccagccacatctccagcgcacaagaacttcaaaacgcataaaccacagcagccagatgttcctccaggactttcttccccaggatcttgcttcaagtgctggaaatctggccactgagccttggaatgcccactacctgggattcctcctaagccgtgccctgtctgtgtgaacccccactggaagtcagactgtccagctcacatcgctgccactcctaaagctcctggagatcaaacccaacattccttggctgactccttcccagatctcctcggcttagtggctgaagattgacactgcccgagcgcctcagaaacctccaggaccatcacagaccctttgggtaactcttacagtggtgggtaagtccgtccccttcttaatcaatacagaggctacccactccacattaccttcttttcaagggcctgtttcccttgcctccataactgttgtgggtattgatggccaggcttctaaaactcttaaaactccccaactctggtgctaacttggacaacattcttttatgcacttctttttagttatcccacctgcccaactcccttattaggtcgagacattttaactaaattagctgcttccctgactattcctgggctacagccacatctcattgcctctcttttccccagttcaaagcctcaccccttactatcccattaaaacctaatcacccttaccccactcaatgccagtatcccatcccacaacaggatttgaggtgactaaagcctgttatcactcacctgttacagcatggccttttaaagcctacaaactctccttacaactctcctatcctacctgtacaaaaaccggacaagtcttacaggttggttcaggatcttcaccttattaatcaaatcgtccttcccatccatcctatagtgccaaactcatatactctcctatcctcaatacctccctccacaacccattattctgttctggatctccaagatgctttctttactattcctttgcacccttcatcccagcctctctttgctttcacttggactgaccctgacacccatcagcctcagcaacttacctgggctgtactgccacaaggcttcagggacagcccccattacttcagtcaagccctttctcatgatttactttctttccatccatctggttctcaccttattcaatactttgatgaccttctactttatagctccccctacaaatcttcccaacaggacaccctcctgctcctccaacatctattctcaaaaggatatcgcatatcccctctaaagcccaaatttcttcctcatccattgcctatctcagcataattctcataaaaacacatgtgctctccctgctgatcgtgtccagctaatcttccaaaccccaaccccttctacaaagcaaaaactcctttccttcctaggcatggttacgtactttcacctttggatacctggttttgctatcctgactaaaccattatataaactcacaaaagcaaacctagctgaccccatcctaaatcctttcccccactcctctttccattccttaaaaacagccctagaagctgctcccacactagctttccctaactcatcccaaccctttttcattacacgtagccgaagtgcagggctgtgcggtcagaattcttacacaagggccaggaccccaccctgtagcctttctgttcaaacaacttgaccttactgttttaggctggcccccacattatttctgataccacacctgacccccgtgactgtgtctgtctaatccacttggcattcactccatttccccatatttccttctttcctgttcctcactctgatcacacttggtttattgatggcagttccaccaggcctaattgccactcaccaggaaaggcaggctatgctatagtatcttccacatctatcattgaggctaccgctctgccccactccactacctctcaacaagccgaactcatttccttaactcgagccctcattcttgcaaaaggactgcatgctaatatttatactgactttaaatatgccttccatactgcaccaccatgctgttacatgggctgaaagagatttcctcttctcaaggccgctttatttccaaaggaagctggagtcattcactgaaaaggccatcaaagggcctcagaccccattgctcaaggcaacaattatgctgataagacagctaaagaagcagcctgtattcctacttctgtccctcatggccagtttttctcctcatcagtcactcctacttactctcccactgaagtttccacatatcaatccctccctactcaaggcaaatggttcttagaccaaggaaaatacctccttccagcctcacaggctcattccattctatcgtcctttttaacctcttccatgtgggttacaagccacgagctcgcctcttagaacctctcatttcctttaagacatttgccctgcatttcactccatccttggctaccttccccttgttcttcggactctcctcctagctgtcctcttgcttgcttatacctggccccatgaatagcagtgaaaggttattcatagacactatgcgctttctcatacaccataaaaatcgaacctccccctctacccagttgcatcatcaatccccattgcaacctct

SEQ ID NO: 478 - DNA, 10347 bp, Homo sapiens
agagacaggactagctggatttcctaggccaactaagaattcctgagcctagctggggaaggtgactgcacccatctttaaacatggggcttgtaactcagctcacacccgaccaatcaagtagtaaagggagctcactaaaataccaattaggctaaaagcaggaggtaaagaaatagtcaatcatctatcgcctgagagcacagcgggagggacaatgatcaggatataaacccaggcattggagccaacagtagcaacccccttttggtcccctcccattgtatgagagctctgttttcactctattaaatcttgcaactgcacactcttctggtccgtgttttttccggcttgagctgagcttttgcttgccatccaccactgctgatcaccaccgtcgcagacccgtcactgacttccacccctccggatctggcagggtgtctgctgctcttctgatccagtgagacacccattgccactcctgactgggctagaggctcgccattgttcctgcatggctaagtgcccgggttcatcctaatcgagctgaacactagtcgctgggttccacggttctcttccataacccatggcttctaatagagctataacactaaccacatggcccaaggttccattctttggaatccatgaggccaagaaccccaggtcagagaatagaaggcttgctgccatcttgggagcggcccaccaccatcttgggagctctaagaacaaagacccgcttgtaacatttggtggcccatatggggattctccaaagtggtgagtaatactgggccatttttgcttgctattctgtcctatccttccttggaattggaggaaaatatagggcacctatcggctggttaaaaatgattagcgtggccgccggagtgaggctttctggaaaaaggctttctaacaacccccaacccttctgtgttgggagcattggtctgcctggaaccagcttctgttttcacaatattcctgggggaagccgagggccaactagaggcagaaagctgtcgtcctgaactcctggcattggccagttgagatcatggtgcagccagaagtctctactcaacagtcgtccatgcgtgtgcccctacctctccttctgacccatacctcctgggtcctgaccatgactttcttgaaagtgtagccccaaaattctccttacctctgtatctacttcctcctatccctgtctcctaggtactaatgcttcaggctttcacttcctttcccaagtattagagcaagttgtatctccaaagggatctaaggaagctctacactgcatccttaggcacctaggctatgaatgcagggaatcttgtccctggtgtctctcccaatttaggtatacagctctcgacatgggcagttatgtgggatccattccccaccacactagccagggccccaagttctattatgagctgtggaccaagtttgtaaatggctaggaggattgatcttccactgtgtaagatgttcttctcccccaatttctacccagtttacccaccctgtaatacaatctccaagccttggctccttggccagggccttagaactgatgacccagtactttaataattggaactgggtctatgacaacataatagatcaggatgaaaacgaattgagtaaattaaagggaggcacatattcctataacggcaaatgggggcaacgagcgaacgtccttccactgtgttcccaaaatccatctaccaagagaggaattatctctttcacagctttgcctagtgattctatgtaagtcaatactactggaaggacaacatagtgcccagaagtttattaactggactttagcacataaaaaccagcaagcccacgccgggcatggtggctcacacctgtaatcccagcactttgggaggccgagacgggtggatcacctgagatcaggagttcgagaccagcctggccaacatggtgaaaccccgcctctactaaaaatacaaaaattagccgggtgtggtggtgggcgcctgtaatcccagctactcaggaggctgaggcagaagaatcacttgaacctgggaggcagaggttgcagtgagccaagatcacgccactgcactccagcctgggtgatggagcaagactccatctcaaaaaaaaaaaaaaaacaaaaaaaacccagcaagcccatccttttctcattgctctccttctcgtaggaaaaaggcacacaagataaacaggatccatctctcctatttcttacccaaaaggacttaatctggggcaacaagaggtttaagatagataattagggcatattcctgcaaaggaaaagaaggataaaggccctagtggggaaaaattctatctcaatcctgactcaaaaagttacttacaccctctctgaaatgaatttgcataggaactgttgcttatgggaccaactgggttgcaactgggttgcagatggggcaactgggttgttatgaaatactcaggaaaccagcccagctctagaactcacccctgagcacaaaggtgatgttgggcacactggtaaaggaccactagaatccagcagcctggacccctttctttgtggtcaagaaaggcaggaaaacaggtgcaggactgctacatcggtgagcataactaatccgataagcagaggtccatggctggtcacacaccctggaaaggaataagcgttaggaccatagaggacactctaggactaatgctcatcggaaaatgactaggggtgctggcattcctatgttcttttttcagatgggaaatgttcccccggctccttccccaactaataaggaccccccttcaacccaaaccgtccaaaaggagatagacaaaggggtaaacaatgacccagagtgccaatattccccgattatgccccctccaagcggtgggaggaggagaattcagcccagtcagagtgcatgtaccgtttttccctctcagacttgaaacaaactaaaatagacctagataaattctcagataaccctgatggctatattgatgttttataagggttaggacaatcctttgatctgacatggagagatataatgttactgctagatcaaactgtaaccccaaatgagagaagtgctgccataactgcagcctgagagtttggtgatctctggtatctcagtcagttcaatgataggatgataacagaggaaagagaatgattccccacaggccagcaggcagttcccagtgtagaccctcactgggacacagaatcagaacatggagattggtgccgcagacatttgctaacttgcatgctagaaggactaaggaaaactaggaagaagcctatgaattattcaattatgtgcactataacacagggaaaggaagaaaatcctattgccttcctggagagactaagggaggcattgaggaagcatacctctctgtcacctgactctattgaaggccaactaatcttaaaggataagtttatcactcagtcagctgcagacattagaaagaaacttcaaaagtctgccttaggcttggaacaaaacttagaaaccctattgaacttggcaacctcggtttttaataatagagatcaggaggagcaggtggaatgggacaaacgggttaaaaagaaaagccaccgctttagtcatggccctaaggcaagcggacttcggaggctctagagaaaggaaagcctcagcaaatagaatgcctaatagggtttgtttccagtgcagtctacaaggacgctttaaaaaagattgtctggccgggcgcggtggctcacgcctgtaatcccagcactttgggaggctgaggcaggtggatcacaaagtcaggcgatcaagaccatcctggctaaaacagtgaaaccccatctctactaaaaatacaaaaaattagctgggtgtggtggcgggcgcctgtagtcccagctcctcgggaggctgaggcaggagaatggcgtgaaaccgggaggcggaggttacagtgagccaagattgggccactgcactccagcctgggtgacagagcaagactccctctaaaaaaaaaaaaaaaaagattgtctgaatagaaataagccgccccctcgtacatgccccttatgtcacgggaatcactggaaggcccactgccccagggtacgaaggtcctctgagtcagaagccactaaccagatgatccagcagcaggactgagggtgcctggggcaagcgccatcccatgccatcaccctcacagagccccaggtatgcttgaccattgagggccaggaggctaactgtcttctggacagtgcaggcttctcagtcttactctcctgtcccagacaactgtcctccagatctgtcactatccgaggggtcctaggacaggcagtcactagatacttttcccagtcactaagctgtgactggggaacttttttcacatgcctttctaattatgcctgaaagccccactcctttgttagggagagacattctagcaaaagcaggggccattatacacctgaacataggagaaggaacacccattttttgtcccctacttgaggaaggaattaatcctgaagcctgggcaacagaaggacaattggacgagggaagaatgcctgtcctgttcaagttaaactaaaggattccgcctcctttccctaccaaaggcagtacccacttagacccgaggcccaacaaggactccaaaagattgttaaggacccaaaagcccaaggcctagtaaaagcatgcaatagcccctgcaatactccaattttaggagtacagaaacccaatggacagtggaggttagtgcaagatctcaggattatcaatgaggccattgtccctatatacccagctgtacctaacccttatattctgctttcccaaataccagaggaagcagagtggcttacagtcctggaccttaaagatgcctttttctgcatccctatacatcctgactctcaattcttgtttgcctttgaagatccttggaacccaacatctcaacccacctggactgttttaccccaagcggtcagggatagcccccatctatttggccaggcattagcccaagactttagccagttcttatacttggacactcttgtcctttggtatgtggatgatttacttttagctgcccgttcagaaaccttgtgccatcaagccacccaagcgctcttaaacttcctcgccacctgtggctactaggtttccaaaccaaaggctcagctctgctcacagcaggttaaatacttagggctcaaattatccaaaggcaccagggccctcagtgaggaatgcatccagcctatactggcttatcctcatcccaaaaccctgaagcaattaggagggttccttggcataacaggcttctgccgaatatggaatcccaggtatgtcaaaatagccaggccattatacacactaattaaggaaactcagaaagccaacactcatttagtagaatggatacctgaagcagaagcagcttcccaggccctaaagaaggccctaacccaagccccagtgttaagcttgtcaacggggcaagacttttctttatatgtcacagaaaaaacaggaatagctctaggagtccttacacaagtccgagggaccagcttgcaacccgtggcatacatgagtaaggaaattgatgtagtggcaaagggctggcctcattgtttatgggtagtggcagcagtagcagtcttagtatctgaagcagttaaaatgatacagggaagagatcttactgtgtggacatctcatcatgtgaatggcatactcactgctaaaggggacttcgggttgtcagacaaccatttgcttaaatatcaggccagtctattacttgaagggccagtgctgcaactgcacacttgtgcaactcttagccacatttcttccagacaatgaaaaaaagatagagcataactgtcaacaagtgattgctcaaacctatgccactcaaggggaccttctagaggttcccttgactgatccccacgtccccacatcaacttgtatactgatggaagttcctttgtagaaaaatgacttcgaaaggcgaggtatgcagtggtgagtgacaatggaatacttcaaagtaatcccctcactccagaaactagcgctcagctggcagaactaatagccctcacttgggcactagaacacaggagaaggaaaaagagtaaatatatatacagcctataggtatgcttacctagtcctccatgcccacgcagcaatatggagagaaagggaattcctaacttccaagggaagacctatcaaacatcaggaagacattaggagattattattggcggtacagaaacctaaagaggtggcagtcttacactgccagggtcatcagaaaggaaaggaaagggaaatagaagagaaccaccaagcggatactgaagtcaaaagagccgcaaggtgggaccctccattagaaatgcttatagaagggcccctagtatggggtaatcccctccaggaaaccaagccccagtactcagcaggagaaatagaatggggaaccgcatgaggacatagcttcctcccctcaggatagctagccactgaagaaggaaaaatacttttgcctgcagctaaccaatagaaattacttaaaacccttcacccaacctttcacttaggcattgataacacccatcagatggccgaatcattatttactggaccaggccttttcaaaactaccaagcagatagtcagggccggtgaagtgtgccaaagaaataatcccctaccttattgccaggctccttcagaacaaagaacaggccattacccaggaaaatactggcaactagattttacccacatgcccaaatctcagggatttcagtatctactagtttgggtggatactttcactggttgggcagaggccttcccttgtaggacagaaaaggcccaagagataataaaggcactaattcattaaataattcccagagttggacttccccaaggcttacagagtgacagcggccacgctttcaaggctgtaggaacccagggagtatccgaggagttaggcatacaatatcacttacaccatgcctggaggccacaatcctcaggaaaagtcgagaaaatgaatggaacactcaaacaacatctaaaaaagctaacccaagaaacccgccttgcatggcctgctctgttgcctatagccatattaagaatccaaaactctccccaaaaagtgggacttagcccatacaaactgctgtatggacagcccttcctaaccaatgaccctgtgcttgaccaagagatggccgacttagttgcagacatcacctccttagccaaatatcaacaagttcttaaaacactgcagggaaccagccgggcgcagtggctcatgcctgtaatcccagcactttgggaggccgagacgggtggatcacctgagatcaggagttcgagaccagcctggccaacatggtgaaacctcatctctacttaaaatacaaaaaattagctgggtgtggtggtacgcacctgtaatcctaggtattcgggaggctgaggcaggagaatcacttgaacccgggaggtggaggttgccgtgagccgagatcgtgccactgcatgccagactgggggacaagagcgagacatcatctcaaaaacaaacaaacaaaccaaaaaaaccacacattacagggaacctgtcccggagaggagggaaaggaattattccaccctggtgacatggtattggtcaagtcccttccctctaattccccatccctagatacatcctggaaaggacgctacccagtcattttatctaccccaaccgtggttaaagtggctggattggaatcttggatacatcacactcgagtcaaaccctggatagtgccagaggaacccgaaaatccaggagacattgctagctattcctgtgaacctctagaggatctgcgcctgctcttcaagagacaaccgtgaggaaagtaactagaatcgtagatccccatggccctcccttctcatatttttctctttactgttctcttaccccctttcactctcactgcaccttatccatgccactgtactgtcagaagctccccttaccaagagcttctatgaacaatgtagcttcccagaaatattgacgccccatcgtataggattttttctaaaggaaaccccactttcaccgcccacacccgtatgccccacaactgctataactctgctactctttgcatgcatgcaaatactcattattggagagggaaaataattaatcctagttgtcctggagggtttggagccactgtctgttggacttacttcacccatactggtatgtctgatgggagtggagttcaagatcaggcaagagaaaaacacgtaaaggaagtaatctcccagctgacgcaggtacatagatagcacccctatcccctacaaaggactagacctctcaaagctacatgaaaccctccatacccatactcacctggtaagcctatttaataccaccctcattgggctccatgaagccttggcccaaaaccctactaactgttggatgtgcctccccctgcactcaggccatatatttcaatccctgtatctttaacctccttgttaagtttgtctcttccagaatcgaagctgtaaaactacaaatggttcttcaaatggagccccagatgcaatccgtgactaagatctaccacagacccctggaccggcctcctagcctatgctctgatgttgatgacatcaaaggcaaccatcccaaggaaatatcaactgcacgacccctgctacaccccaattcagcatgaagcagttagagtggtcatcggccaacctccccaacagcacttgggttttcctgttgagaggggggactgagagataggactagctggatttcctaggccgacttagaattcttaagcctagctggggatggtgactgcacccacctttaaacacggggcttgtaactcagctcacacccgaccaatcaggtagtaaagagagctcactaaaataccaattaggctaaaggcaggaggtaaagaaatagtcaatcatctatcacctgagagcatagggggagggacaatgaccgggatataagccaggcatttgagccagcagtggcaaccccctttgggtcccctcccattgtatgggagctctgttttcactctattaaatctttttttaaatttattattattattatacttaaagttttagggtacatgtgcacaatgtgcaggttagttacatatgtatacatgtgccatgctggtgtgctgcacccattaactcgtcatttagcattaggtatatctcctaatgctatccctcccccctcccccaaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttcctattgtgaatagtgccacagtaaacatacgtgtgcatgtgtctttatagcagcatgatttatagtcctctgggtatatacccagtaatgggatggctgggtcaaatggtatttctagttctagatccctgaggaatccactctattaaatcttgcaactgcgcactcttctggtccgtgtttcttccggctcaagctgagctttcgctcacagtccaccactgctgattgccgccgttgcagacccgccgctgacttctagccgtccggatccggcagggtgtctgctgtgcttctgatccagcgaggcacccactgctgctctggatggggctagaggctcgccattgttcctgcgtggctaagtgcccgggttcgtcctaatcgagctgaacactagtcgcgggggtccacggttctcttccgtgacccatggcttctaatagagctataacactcaccgcatggcccaaggttccattccttggaatccgtgaggctgagaaccccaggtcagagaacaaaaggcttgccgccatcttgggagtggcccgtcgccatcttgggagctctaagaacaaacacctgctggtaacact

SEQ ID NO: 479 - DNA, 419 bp, Homo sapiens
gtcaggcctctgagcctaagctaagccatcatatccccagtgacctgcatgtacacatccagatggcctgaagcaactgaagaatcacaaaagaagtgaaaatggctggttcctgccttaactgatgacattgcaccattgtgatttgttcctgccccaccttaactgatcaataaaccttgtgaaattccttagaagctcccccactgagcatcttgtgacccccgcccctgcccgcaagagaaaaaccccatttgactgtaattttccactacccacccaaatcctataaaactgtcccacccttatctccctttgcttactctttttggactcagccgccctggacccaggtgattaaaaagctttattgctcacacaaagcctgtttggtggtctctttacacgaacgcgcgtga

SEQ ID NO: 480 - DNA, 468 bp, Homo sapiens
gtaggagatcggtcaggatggtgggaaaagttgtaagataaattataggaaaaggatgcaaaccttcttggaaggcctgggatttgcatagcttcagaagaggatttggctgaaggcagctgaattttctcagaatggataacaaggaagtgtaaaggaattgatctagataagttagtttacttaggcctcggaacctggtatttaatcatctgtgcacaggactgctgtcttggggggtggggggtgacaatgttaattacccacaagacgtgttgactccaggcctttgtcattaaatctgtactgaataaatgcccacagtgccagcttgtcggggctgtggctactgactctttacagctccctcctcggtgtctgtgagctgcccagtcccctagcctgctttttcactggatatcagtctcagagtgcatttttcatctgtcattcggccaggttggaccc

SEQ ID NO: 481 - DNA, 968 bp, Homo sapiens
gtggggaaaagaaagagaggtcagattgttactgtgtctgtgtagaaagaagtagacataggagactccattttgttctgtactaagaaaaattcttctgccttgagatgctgttaatctgacaccctacccccaaccccgtgctctctgaaacatgtgctgtgtccactcagggttaaatggattaagggctgtgcaagatgggctttgttaaacagatgcttgaaggcagcatgctcgttaagagtcatcaccactccctaatctcaagtacccagggacacaaacactgcggaaggctgcagggacctctgcctaggaaagccagatattgtccaaggtttctccccgtgtgatagtctgaaatatggccttgtggggagggaaaggccctgaccgtcccccagctcgacacccataaagggtctgtgctgaggaggattagcaaaagaggaaggaatgcctctttgcagttgagacaagaggaaggcatctgtctcctgcccatccctgggcaatggaatgtctcggtataaaacctgattgtatgttccatctactgagataggggaaaactgccttagggctggaggtaggacatacgggcaacaatactgctctgtaaggcattgagatgtttatgtgtatgcatatctaaagcacagcacttaattctttaccttggctatgatgcagagacctttgttcacgtgtttatctgctgaccttctctccactattatcctgtgaccctgccacaaccctctctctgagaaacacccaagaatgatcaataaatactaagagaactcagaggctggcaggatcctccgcatgctgaacgctggtcccctgggcccccttatttctttctctatactttgtctctgtgtctttttcttttccaagtctctcattccacctaacgagaaacacccacaggtgtggaggggcaacccaccccttca

SEQ ID NO: 482 - DNA, 3476 bp, Homo sapiens
ggctctggaaaagggaagagctgggcaaactgaatgctaatagggcttgcttccagtgcggtctacaaggacactttaaaaaagattgtccaaatagaaataagccgccccctcgtccatgtcccttatgtcaagggaatcactggaaggcccactgccccaggggatgaaagtcctccgagtcagaagccactaaccagatgatccagcagcaggactgagggtgcccgggccaagtgccagcccatgccatcaccctcacagaaccccgggtatgcttgaccattgagggtcaggaggttaactgtctcctggatgctggcacgaccttctcagttttactctcctgtcccagacaactgtcctccagatctgtcactatccaaagggtcctaggacaggcagtcactagatacttctcccagccactaagctgtgactggggaactttattcttttcatatacttttctaattatgcctgaaagccccactcccttgttagggagagacattctagcaaaagcaggggccattatacacctgaacataggagaaagaacatccatttgttgtcccctgcttgaggaaggaattaatccatcctgaagtctgggcaacagaaggacaatatggacgaacaaagaatgcctgtcctgttcaaattaaactaaaggattctgcctcctttccctaccaaaggcagtaccctcttagacccaaggcccaacaaggactccaaaaaattgttaaggacctaaaagcccaaggcctagtaaaaccatgcaatagctcctgcaatactccaattttaggagtacagaaacccaacagacagtggaggtcagtgcaagatctcaggattatcaatgaggctcttatccctctatacccagctgtacctaacccttgtactctgctttcccaaataccagaggaaccagagtggtttacagtcatggaccttaaggatgcctttttctgcatccctgtacatcccaactctcaattcttctttgcctttgaagatccttcaaacccaacgtctcaactcacctggactgtcttatcccaagggttcagggatagcccccatctatttggccaggcattagcccaagactttagccagttctcatacttggacactcttgtcctttggtacgtggatgatttacttctagccgcccattcagaaaccttgctccatcaagccacccaagcgcttttaaacttccttgccacttgtggctacaaggtttccaaaccaaaggctcagctctgcttacagcaggttaaatacttaaggctaaaattatccaaaggcactagggccctcagtgaggaatgtatccagcatatactggcttatcctcatcccaaaaccctaaagcaactaagagggctccttggcataacaggcttctgccgaatatggattcccaggtatggcaaaatagtcaggccattaaatacactaattaaggaaactcagaaagccaatacccatttagtaagatggacacctgaagcagaagcggctttccaggccctaaggaaggccctaacccaagccccagtgttaagcttgccaacggggcaagacttttctttatatgtcacagaaaaaaaataggaatagctctaggagtccttacacaggtctgagggaccagcttgcaacctgtggcatacttgagtaagaaaattgatgtagtggcaaagggttggcctcattgtttacaggtagtggcagcagtagcagtcttagcctccgaagcagttaaaataatacaaggaagagatcttatgtgtgtggacatctcatgatgtgaacagcatactcactgctaaaggagacttgtggctgtcagacaaccattagcttaaatatcaggctcttatttgaagggccagtgctgcgactgcgcacttgtgcaactcttaacccagccacgtttcttccagacaatgaagaaaagatagaacataactgtcaacaggtgattgctcaaacctacgccgctcgaggggaccttctagaggttcccttgactgatcccaacctcaacttgtatactgatggaagttcctttgtgaaaaaaggacttcaaaaagtggagtatgcagtggtcagtgataatagaatacttgaaagtaatcccctcactccaagaactagcattcagctggcaaaactaatagccctcactcgggcatcagaattaggaaaaggaaaaatggtaaatatatatacagactctaagtatgcttacctagtcctccatgcccacacagcaatatggagagaaagggaatttctaacttccgagaacacctatcaaacatcaggaagccattaggagattattattggctctacagaaacctaaagaggtggcagtcttacactgccggggtcatcagaaaggaaaggaaagggaaatagaagggaaccgccaagcggatattgaagccaaaagagctgcaaggcgggaccctccattagaaatgcttatagaaggacccctcttatggggtaaccccctccaggaaaccaagccccaatactcagcagaagaaatcgaatggggaacctcacgaggacatagtttcctcccctcaggatggctagccacgaaagaaggaaaaatacttttgcctgcagctaaccaatggaaattacttaaaacccttcaccacacctttcacttaggcattgatagcacccatcagatggccaaatcattatttactggaccaggccttttcaaaactatcaagcagatagtcaaggcctgtgacgtgtgccaaagaaataatcccctgcactgcagggtattatttgaatacatttgaatccctgtatctttaacctccttgttaagtttgtctcttccagaatcaaaggtgtaaaactacaaatcgttcttcaaatggagccccagatgcagtccatgactaagatctaccgaggacccctggaccagcctgctagaccatgctccaatgttgatgacatcgaaggcacccctcccaaggacccctgcatgacccctactacactccaattcagcaggaagcagttagagcggttgtcggccaacctccccaagagcacttgggttttcctgttgagaggaggtaccgagagacaagactagctggatttcctaggccgactaagaatccccaagcctagctgggaaggtgacgcatccacctttaaacacagggcttgcaacttagctcacacccaaccaatcaagtagtaaagagagctcactaaaatgctaattaggcaaaaacaggaggtaaagaaatagccaaacatctatcgcctgcctgagagcacaggggaaggaacaatgatcgggatataaacccaggcatttgagctggcaatggctacccactttgggtcccctccctttgtatgggagctctgttttcactctattacatcttgcaactgca

SEQ ID NO: 483 - DNA, 5941 bp, Homo sapiens
gtcaggcctctgagcccaaactaagccatcatatctcctgtgacctgcatgtacatatccagatggccggttcctgccttaactgatgacattgtcttgtgaaactccttctcctggctcatcctggctcaaaagttcccctactgagcaccttgtgacccccactctgcccaccagagaacaacccccctttgactgtaattttccttcacctacccaaatcctattggccccacccctatctccctttgctgactctcttttcggactcagcccacctgcacccaggtgaaataaacagcttcgttgctcacacaaagcctgtttggtggtctcttcccacggacgtgcatgaaatttggtgctgtaactcggattgggggacctcccttgggagatcaatcccctgtcctcctgctctttgctccctgagaaagatccacctaggacctcaggtcctcagaccaaccaggccaagaaacatctcaccaatttcaaaaccggtaagcggcctctttttactctcttctccagcctccctcactatccctcaacctctttctcctttcaatcttggcaccacacttcaatctctcccttctcttaatttcaattcctttcattttctggtagagacaaaggagacacgttttatccgtggacccaaaactccggcgccggtgtttaatcattgcagggacgcctctctgattatttacccaggtttcagaggtgtcagaccatgcaaggacgcctgccttggtccttcacccttagcagcaagtcccacttttctggggaaggggcaagtaccccaatcccttctctccatgtctctaccccttctccaccttctagggggcaagaaacccccaaccccttctccttcacccttagcggcaagtcccgcttttctgggggaggggaaagtaccccaaacccttatatctctgtgccccgatcccttatttccgctccccaacctcttatatctctgcaccccgatcccttatttctgtgccccagcctcttatatctctgcactccaatcccttatttctgcaccccgacctcgtatctctgtgccccgacccccttcccgcttttctggagggtaagaacccccgaaccccttccctccgtgtctctactctctcttttctctgggcttgcctccttcactatgggcaaccgtacaccctccattcctccttcttctcccttagcctgtgttcttaagaacttaaaacctcttcaactctcacctgacctaaaatctaagcatcttattttcttctgcaatgttgcttgaccccaatacaaactcaacagtagttccaaatagccagaaaatggcatttcaatttttccatcctgcaagatctaaataattcttgtcgtaaaattggcaaacggtctgaggtgcctgatgtccaggcattcttttacacattggtccctccctagtctctgtgcccagtgcaactcgtcccaaatattccttctttccctcccacctgtcccctcggtcccaaccccaagcgttgctgagtctttctactcttccttttctacagacccatctgacctctcccctcctccccaggctgctcctcgccaggccgacctaggtcccaattcttcctcagcctcagctcctccaccctataatccttttatcacctcccctcctcacacctggtctggcttacagtttcattccatgactagccctcccccacctgcccagcaatttactcttaaaaaggtggctggagctaaagccacagtcaaagttaacgctcctttttctttatcccaaatcagatagtgtttaggctctttttcatcaaatataaaaatccagcccagttcatggctcgtttggcagcaaccctgagacactttacagccctagaccctaaaagatcaaaaggctgtcttattctcaaaatacattttattacccaatctgctcccgacattaaataaaactccaaaaattaaattccggccctcaaaccccacaaaaggatttaattaacctcgccttcaaggtatacaataatataaaaaagttgcaattacttgcctccactgtgagacaaactccagccacatctccagcacacaagaacttccaaacgcctgaaccgcagcagccaggcgttcctccagaacctcctcccctaggagcttgctataagtgccagaaatctgaccaccaggccaaggaatgcctgcagcccaggtttcctcctaagccgtgtcccatctgtgcaggaccccactggaaatcggactgttcaactcacctggcagccactcccagagcccctggaactctggcccgaggctctctgactgactccttctcagcttagcagctgaagactgatgctgccccattgcctcagaagccccgtagaccatcatggatgccgagcttcaggtaactctcacagtggaagataagtctgtcccgttagtcaatacggaggctacccactccacgttaccttattttcaagggcctgtttcccttgcctccataactgttgtgggtattgacagccaggcttctaaacccctgaaaactcccccactctggtgccaacttggacaacactcttttatgcactcttttttaattatccccacctgcccagttcccttattaggccgagatattttaaccaaattaactgcttccctgactattcctggactacagccgcatctcattgctgcccttctccccaacccaaagcctccttcgtgtcttcctctcgtatccccctaccttaacccacaagtatgggacatctctactccttccctggcaaccgatcacatgcccattaccatcccattaaaacctaatcacccttaccccgctcaatgccaatatcccatcccacagcacgctttaaaaggattaaagcctgttatcactcgcctgctacagcatgggcttctaaaacctataaactctccttacaattcccccattttacctgtcctaaaaccagacaagccttacaagttagttcaggatctgcgccttatcaaccaaattgttttggctatccaccctgtggtgcccaacccgtacactcttttgtcctcaataccttcctccacaactcactattccattctggatcttaaagatgcttttttcactattcccctgcacccctcatcccagcctctctttgctttcacttagactgaccctgacacccgttaggctcgcaaattacctgggctatattgccgcaaggcttcacagacagcccccattacttcagtcaagcccaaatttcatcctcatctgttacctatcagcataatgctcaaaaacacacgtgctttccctgctgattgtgtctgattaatctcccaaacctcaatcccttacaaaacaacaactcccttccttcctaggcatggttagtgtggtcagaattcttacacaagagccaggactgcaccctgtagcctttctgtccaaacaacttgaccttactgttttagcctagccatcatgtctccgtgcagtggctgctgccgccctaatacttttagaggccctcaaaatcacaaactatgctcaacttactctctacatttctcataacttccaaaatctattttcttcctcatacctgacacatatactttctgctccccagccacttcagctgtactcactctttgttaagtcccacaattaccattgttactggccgggacctcaatctggcctcccacattattctggataccacacctgaccctcatgactgtatctctctgatccacctgacattcaccccatttccccatatttccttctttcctgttcctcaccctgatcacacttgatttattaatggtggttccaccaggcctaatcgccacacaccagcaaaggcaggctatgctatagtacaagtcactagcccacctcttaaaacctctcatttcctttccatcgtggaaatctatcctcaaggaaataacttctcagtgttccatctgctatgctactactcctcaaggattattcaggccccccctcccttccctacacatcaagctcgaggatttgcccccacccaggactggaaaattagctttactcaacatgccccaagtcagataactaaaatacctcttagtctaggtagacactttcactggataggtagagtcctttcctacagggtctgagaaggccacctcagtcatttcttcccttctgtcagacataattcctcagtttagccttcccacctctatacagtctgataatggaccagcctttattagtcaaatcagccaagcagttttccaggcacttagtattgagtgaaacctttatatcccttacagtcctcagtcttcaggaaaagtagaacagactaacggtcttttaaaaacatacctcactaccgggcgtggtggctcatgcctgtaatcccagcactttgggaggctgaggcgggtggatcacgaggtcaggaaatcgagaccattctggctaacatggtgaaaccccgtctctactaaaaatacgaaaaaattagccgggtgtgatggcgggcgcctgtagtcccagctacttgggaggctgaggcaggagaatggcatgaacccgggaggcggagcttgcagtgagccaagatcgcgccactgcactccagcctgggtgaaagagcaagactccgtctcaaaaaaaaaaaaaaaaaaaaaaaaacacctcacgaagctccagcttaaaaaggactagacaatacttttactactttccgttctcagaagtcagacctgtcctcagaatgctacagggtacagcccatttgagctcctgtatagatgctcctatttattaggccccagtctcattacagacaccagactaacttagactgtgccccaaaagaacttgtcatccctactatcttctgtctagtcatactcctattcaccggtctcaactactcatacatgccctgctcttgtttacactgccggtttacactgtttctccaagccatcacagctgatatctcctggttctatccccaaactgccactcttaactcttgaagtaaataaataatctttgctgacaggactatgctgaatttccttaggcactctctaattaaatgtcctaggtcctcccaattcttagaccattaatacctgtttttctccttctcttaatccgtttagtttttcaattcatacaaaaccttatccaggccatcaccaataattctaaatgacaaatgtttcttctaacagtcccacaatatcaccccttaccacaaaatcttccttcagcttaatctctcccactctaggttcccacgccgcccctaatcctgctcaaagcagccctgagaaacatcacccattatctctccataccacccccaaaaattctcaccgtcccaacactttaccactatttcattttatttttcttattaatataagaggataggaatgacaggcctctgagcccaagctaagccatccctgtgacctgcacgtacacatccagatcacatccagatggccggttcctgccttaactgatgatattccaccacaaaagaagtgaaaatgtcctgttcatgccttaactgatgacattgtcttgtgaaattccttctcctggctcatcctggctcaaaagttcccctactgagcaccttgtgacctccactctgcctgccagagaacaacccccctttgactgtaattttcctttacctacccaaatcctataaaacggccccaccccatctcccttcactgactctcttttcagactcagcccacctgcacccaggtgaaataaacagctttattgctcacacaaagcctgtttggtggtgtcttcacacggacacacatgaaa

SEQ ID NO: 484 - DNA, 5800 bp, Homo sapiens
gtcaggcctctgagcccaagctaagccatcatatcccctgtgacctgcacgtatacatccagatggcctaaagtaactgaagaatcacaaaagaagtgatatttaaatggccttttcctgccttcactgatgacattccaccacaaaagaagtgaaaatggctggtccttgccttaactgatgacattactttgtgaaattccttctcctggctcatcctggctcaaaaagctctcctactgagcacgttgtgaccccctactcctgcccaccagagaacaacccccctttttcctttacctacccaaatcttataaaacagcaccacccctatctcccttcgctgactttcttttcgactcagcccatctgcacccaggtgaaataaacagacctgttactcacacaaagccagtttcgtggtctttgtgtgagggacgcgagtgaaattttggtgccgtgacttggatcaggggacctcccttaggagatcaatcccctgttcttctgctctttgttccatgagaaagatccacctacgacctcaggtcctcagaccgaccagcccaaggaacatcacaccaattttaaatcaggtaagcggcctctttttaccctcttctccaacctctctcactatccctcaacctctttctcctttcaatcttggcgccacacttcaatctctcccttctcttaatttcagttcctttccttttctcatagagacaggagacgtgttttatccatagacccaaatctccggtgccagtcacggactcgggaagacagtcttcccttggtgtttaatcatgcggggatgcctgcctgattattcacccacatttcagaggtgtctgactacacggggatgcctgccttggtccttcacccttagcggcaagtactgcttttctggggggcaagaaccccctgaccccttctctccatgtctctaccccttctccacttttctggaaggcaataaccccccgaccccttctccttcacccttagttgcaagtatcacttttctagggagcaagaaccccccgacccctactctctgtgtctctaccccttctccactttcctgggggcaagcatcccccaccgcttctctccatgtctctattctctcttttctctgggcttgcctccttcactatgggcacccttccaccctccattcctccttctcctcccttagcctgtgttctcaagaacttaaaacctcttcaactcacacctgacctaaacctaaacaccttatttacttctacaatgctgcttgaccccaatacaaattcaacagtcgttccaaatagccagaaaacagcacttttgatttttcctttctacaagatctagataattcttatcataaaataggcaaacggtctgaggtgcctgatgtccaggcattcttttacacatcaatccttccctagcctctgttcccaatgcaactcatcccaaatcttccttctttccctcccgcctgtcccctcagtcccaaccccaagcgtcgctgagtctttcctctttccaatcttccttttctacagacccatctgacctctcccctcttccccaggctgttcctttccaggccgagctaggtcccaattcttcctcagcctctgctcctccaccctataatccttttatcacctaccctcctcatacccagtctggcttacagtttcgttctgccacctgcccagcaatttcctcttaaaaaggtggctggagttaaaggcatagtcaaggttaatactcctttttctttatctgacctctcccaaatcagttagcatttagactctttttcatcaaatatgaaaaacccagcccagttcatggcccgtttagcagcaaccctgagacgctttacagccctagaccttaaaaagtcaaaaggctgtcttattctcaatatacattttattacccaatctgctcctgacattaaataaattaccaaaaattaaattccagccctcaaactccacaacaggacttaattaacctcaccttcaaagtgtacaataatagagtagaggcagccaagtagcaatgtatttctgagttgtaattccttgcctccactgcaagacaaaccccagccacatctccagcacacaagaactccagacgcctgaaccgcagctgccagggattcctccagaacctcctcccccaggagcttgctacaagtgccagaaatctggccactgtgccaaggaatgcccacagcctgggattcctcctaagccatgtcccatctgtgcaggaccccactgaaaatcgaactgttcaacttacctggcagtcacttccagtgcccctggaactctggcccaaggctttctgactccttcccagatcttcttggctcagcagctgaagaccgacactgcccaattgccttggaagcttcctggaccatcacagatgctttaaggtaattcttacagtagaaggtaagtctgtccccttcttaatcaatatgaaggctacccactccacattaccttcttttcaagggcctgtttcctttgcctccataactgttgtgggtattgacggccaggcttctaaacatcttaaaactccccaactctagtgccaacttagacaacattcttttatgcactcttttttagttatccccacctgtctagttccattattaggccaagacattttaactaaattatctgcttcactgttcctgaactgcagccacacgtcattgccgcccttttccccagttcaaagcctcctttgcatcctcctctcatatcccccaaccttaacccacaagtataggatacctctactccctccttggcaaccgatcatgcacccccttaccatctcattaaaacctaatcacccttactccactcaacgccaatatcccatcctgcagcacgcattaaaaggattaaagcctgttatcactcacctgctacagcaaggcctttgaagcctataaactctccttacaattccatttcacctgtcctaaaaccagacaaggcttacaggttacttcaggatctgcacattatcaaccaaattgttttgcctctccaccctgtggtgccaaacccatatactctcctatcctcaatacctccctctacaacccattattctgttctggctctcaaacatgctttctttactattcctttgcacctttcatcctaacctctcttcctctcacttggagtgaccctgatacccattaggctcagcaaattacctgggctgtactgctgcaaggcttcacagacagctcccattacttcagtcaagcccaaatttcttcctcatctgttacctatctcagcataattctcatgaaaacagacctgctctctctgctgatcatgtccaactgatctctcaaaccccaacaccttctacaaaacaacaattcctttccttcctaggcatgcttaggtactttcgactttagatacctggttttgccatcctaacaaaaccattatataaactcacaaaaggaaacttagctgaccccatagatcctaaatcctttccccactcctctttccattccttgaagacagctttagagactgcccccgccctagctctccctgactcatcccaacccttttgattacccacagccgaagtgcaggtctgtgcggttggaattcttacacaagaaccaggaccgtgcgctgtagcctttttatccaaacttgacctcactgttttagcctagccctcatgtctgcatgcagtggctgccactgccttaatacttttagaggccctctaaatcacaaactatgctcaactcactctctacagttctcataacttccaaactctattttcttcctcacacctgacacatatactttctgatctctagctccttcagctgtactctttgttgagtctcctacaattaccattgttcctggcctggacctcaatccggcctcccacattattcctgataccacacctggcccccatgactgcatctctctgatccacctgacattcaccccatttccccctatttccttctttcctgttcctcactgtgatcacacttggtttattgatggcagttccaccaggcctaatcaccacactccagcaaaggcaggctatgctatagtacaagccactagcccacctcttagaagctctcatttcctttccatcgtggaaatctatccttaaggaaataatttctctgtgttccatctgctattctactactccttagggattattcaggccccctaccttccctacacatcaagctctgggatttgcccctgcccaggactggcaaattggctttactcaacatgccctgagtcaggaaactaaaatacctcttggtctaagtagacactttaactggataggtagaggactttcccacagggtctaagatggccacggtcatttcttcccttctgtcagacataattcctcgatttggccttcccacctctatacagacgtataatggaccggcctttattagtcaaatcacccaagcagtttctcagactcttagtattcagtgaactaatggtcttttaaaaacacacctcaccaagctcagccgtcaacttaaaaaggactggataatacttttaccacttgcccttctcagaattcaagcttgttctcggaatgctacaaggtacagcccatttgagctcctgtatagacactcctttttattaggccccagtctcattccagacaccagaccaacttagactgcgccccgccccccacaaaaaaaaactacttgtcatccctgctatattctgtctagtcatactcctattcaccattctcaactactcataaatgccctgctcttgtttacactgccggtttacactgtttctccaagccatcacagctgatatctcctgatgctatccccaaaccgccactcttaactccctcttaaagtaattaagtaatctttcctggcagggctatgctgaaactccttaggcactctctagttagatgtcctaggtcctcccaattcttagtcctttaatacctgtttttctccttgtcttattccgttcttttttcaattcatacaaaaccatatccaggccatcaccaataattctacaccacaaatgtttcttctaacaaccccacaatatcaccccttaccacaaaatcttccttcagcttaatctcttccactctaggttcccttgccacccctaatcccgctcgaagcagccctgagaaacatcacccgttgtctctccataccacccccaaaaattttctccccaacacttcaacactattatgttttatttttcttattaatataagaagacaggaatgtcaggcctctgagcccaagctaagccatcatatcccctgtgacctgcatgtatacatccagatggcctgaagtaagtgaagaatcacaaaagaagtgatatttaaatggcctgttcctgccttaactgatgacattactttgtgaaattccttctcctggctcatcctggctcaaaaagctcccccactgagcaccctgtgacccacccccccactcctgccggccagagaacaatccccctttttcctttacctacccaaatcttataaaacggccccaccccatctccctttgctgactctcttttcgactcagcccacctgcacacaggtgaaataaacagccttgttgctcacacaaagcctgtttggtggtctcttcacatggacacgagtgaaa

SEQ ID NO: 485 - DNA, 958 bp, Homo sapiens
gtggggaaaagcaagagagatcagattgttactgtgtctgtgtagaaagaagtagacataggagactccattttgttctgtactaagaaaaattcttctgccttgagattctgttaatctataaccttacccccaaccccgtgctctctgaaacatgtgctgtgtcaactcagagttaaatggattaaggtcggtgcaagatgtgctttgttaaacagatgcttgaaggcagcacgctccttgagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagaccccagcccgacacccgtaaagggtctgtgctgaggaggattagtataagaggaaggcatgcctcttgcagttgagacaagaggaaggcatctgtctcctgcctgtccctgggcaatggaatgtctcggtataaaacccgattgtatgttccgtctactgagatagggaaaaaccgccttagggctggaggtgggaactgcgggcagcaatactgctttgtaaagcattgagatgtttatgtgtatgcatatctaaaagcacagcacttaatcctttacattgtctacgatgcaaagacctttgttcacgtgtttgtctgctgaccctctcccgacaattgtcttgtgaccctgacacatccccctctcggagaaacacccacgaatgatcaataaatactaagggaactcagaggctggcgggatcctccataatgctgaacgctggttccccgggtccccttatttctttctctatacattgtctctgtgtctttttctttcttaagtctctcgttccaccttacgagaaacacccacaggtgtggaggggcaacccacccctaca

SEQ ID NO: 486 - DNA, 777 bp, Homo sapiens
gagagacaggactagctagatttcctcggccgacaaagaatccctaagcctagctgggaaggtgaccgcttccacctttaaacaccgggcttgcaacttagctcacacctgaccaatcatctaggaaagagagctcactaaaatgttaattaggcaaaaacaggaagtaaagaaatagccaatcatctgttgcctgagagcacagcaggagggataatgatcgggatataacccaagcattcgagctggcaaaggctaccttctttgggtcccctccctttgtgtgggagctctgttttcactctattaaatcttgcaactgcactcttctggtccgtgtttgttacagatcaagctgagctgagctcgccatccaccactgctgtttgccgccatcgcagacccgcagctgacttccatccctccagatccagcagggtgtctgctgtgctcctgatccagccaggtgcccattgccactcctgatcaggctaaaggcttgccattgttcctgcactgctaagtgcctgggttcgtcctaatggagctgaacactagtcactgggttccatggttctcttctgtgacccacggcttgtaatagagctataacactcaccacagggcccaagattccattccttggaatccgtgaggccaagaaccccaggtcagagaacacgaggcttgccaccatcttggaagtggcctgccgccattttggaagtggcctgccaccatcttgggagctctcagagcaaggacccccaggtaaca

SEQ ID NO: 487 - DNA, 974 bp, Homo sapiens
gtgggggaaagaaagagagatcagactgttactgtgtctatgtagaaaggagtagacataagaaactccattttgttctgtactaagaaaaattcttctgccttgagatgctgttaatctgtaaccctagcctcaaccctgtgctcgcagagacatgtgctgtgttgactcaaggtttaatggatttagggctgtgcaggatgtgctttgttatgaagtgtttgcaggcagtatgcttggtaaaagtcatcgccattctccagtcttgagtacccagggacacaatgccctgtggaaggccgcagggacctctgcctaggaaagccaggtgttgtccagggtttctccccactgagacagcctgagatatggcctcgtgggaagggaaagacctgaccatcccccagcctgacacccgtaaagggtctgtgctgaggaggattagtgaaagaggaaggcctctgcagttgagataagaggaaagcatctgtctcctgctcctccctgggaatggaatgtcttggtgttaaacccgatcatacattctatttactgagataggagaaaaccgccttatggctggaggtgagacatgctggcggcaatactgctctttactgcactgagatgtttgtgtaaagtcaaacataaatctggcgtacgtgcacatccaggcacagcacctttccttaaacttatttatgacacagagacctttgctcacatgttttcctgctgaccctctccccaccattaccctatagtcctgccacatagccctcaccaagatggtagagatagtgatcaataaatactgagggaactcagagaccagtgctggcatgggtcctccatatgctgagcgctggtcccctgggcccactgttctttctttatactttttctctgtgtcttatttcttttctcagtctctggtcccacctgacgggaaatacccacaggtgtggaggggc

SEQ ID NO: 488 - DNA, 968 bp, Homo sapiens
gtggggaaaagaaagggagaccagattgttactgtgtctgtgtagaaagaagtagacataggaggctccattttgttctgtactaagaaaaattcttctgcattgagatgctgttaatctgtaacactacccccaaccctgtgctccctgaaacacgtgctgtgtcaactcagggttaaatggattaagggctgtgcagggtgtgctttgttaaacaaatgcttgaaggtagcatgcttgttaagagtcatcaccactccctaatctcaaaccacttcctaatctcaagtacccagagacacaaaccactgaggaaggccgcagggatctctgcctaggaaagccaggtattgtccaaggtttctccccatgtgatagcctgagatatggcctcgtgggaagggaaagacctgaccgtcccccagcccgacacccgtaaagggtctgtgctgaggaggattagtaaaagaggaagtaacacctccttgcggttgagacaagaggaaggcatctgtctcctgctcgtccctgggcaatggaatgtctcggtgtaaaacctgattgtatattccatctactgagataggggaaagccaccttagggctggaggtgggacatgcgggcagcaatactgctctttaaggcattgagatgtttatgtgtatacatatccaaagcacagcacttaattctttaccttgtttatgatgcagagacctttgttcacgtgtttacctgctgaccttctctccactattatcctatgatcctgccacatccccctctccgggaaacgcccaataatgatcaataaatactaagggaactcagaggctggcgtggatcctccgtatactgaacgctggtcagctgggcccagttttctttctctatactttgtctctgtgtctcttgttccacctaacgagaaacgcccacaggtgtggaggggcaacccaccccttca

SEQ ID NO: 489 - DNA, 487 bp, Homo sapiens
ttacggtgggtagctagtcaggtatgaacaaagcaggagatggctcccccaaacacacactaggagtgtcgggcaaccatcaggtgagatggtcaggcggttattaactctcttgctgaagtagtaattggtcacagctggcaccagggaacggcagtctcctaatagaaaacacctgaaactggtgagcagcagcttcccaataagatctcaggagttgggcaagtggggagaagtaatgcaagaccttggaagtatgccagtgtataaaacgccaagtcaaaagctcaagccacacatttatctttcaagtcgcccgcttggtcctcttccaagcgtacttccctttctttcattcctcctctaaagctttttaataaactttcactcttgctctaaaacgtgcctcaccctctccttctgcccctcagtcgaattctttcttctgaggaggcaagaattgaggttgctgcagacctgtacggat

SEQ ID NO: 490 - DNA, 1741 bp, Homo sapiens
ctgcacgtatacatccagatagcctgaagaatcacaaaagaagtgaaaaatggccagtttctgccttaactgatgacattaccttgtgaaattccttctcctggctcagaagttccttcactgagcaccttgtgacccctacccctgcccgtaagagaacgaccccctttgactataattttccactgcccacccaaatcccataaaagtgccccaccccatctccctttgctgactccttttatggactcagcctgcctgcacccaggtgattaaaaagctttattgctcacacaaagcctgttggtggtctcttcacacggacacgcatgacatttggtgccgtgactcggatcgggggacctcccttgggagatcaatcccctgtcctcctgctctttgctccatgagaaaaatccacccacaagctcgggtcctcagaccagaccaagaaacacctcaccaattttaaatcgggtaagcggcctctttttactcttctccaacctctctcattatccctcaacctctttctcctttcaatttcggcgccacccttcagtctctcccttcccttaatttcagttcctttccttttccagtagaaacagaggagacgctttttttttttttttttttttttttgagagagttttgctctgtcacccaggctggagtgcagtggtgccatcttggctcactgcaagctccacctcctgggttcccgccattctcctgcctcagcctcccgagtagctgggactacaggcgcccgccaccatgtccggctaatttttttttttgtatttttagtagagacggggtttcactgtgttagccaggatggtctcgatctcctgacctcatgatccacctgcctcggcctcccaaagtgctgggattacaggcgtgagccaccgcgcccggcccgagacacgttttatctgtgaaccaaaaatgccggcgcccgtcatggacttgggaagacaagtcttcccttggtgtttaatcactgcggggatgcctgcctgatcattcacccacattctagaggtgtctgattaccatggggacgcctgccttgatccttcaccttggtggcaagtaccacccccccccccaccggggtggcaagtaccacctcccctgggtggcaagtgcccgcccccacctctgtgtctctaccctctcttttctctgggcttgcctccttcactatgggcaaccttccaccctctattcccccttcttctcccttaacctgtgttctcaaaaacgtaaaacctcttcaactttcgcctgacctaaaacctaagtgtcttattttcttctgcaacaccatttggctccaatacaaaccttgataatggttctaaatagccagaaaacagtgctttcaatttctccatcctacaagatctagataatttttgtcataaaatgggcatagtctgaggtgcctgacatccaggcattcttttacacatttgtccctccctagtctctgctcccaatgtgactcgtcctaaatatttcttctctcctgtctgttccttcagtctccaccccaagctctaagtcctttgaatcctccttttctacggacccatctgacctcttccttcctccccaggctgctcctcgccaggctgagccacgtcccaattcttcctcagcctccgctccccaaccctataatccttctatcatctcccctcctcacacccgctctggcttacag

SEQ ID NO: 491 - DNA, 1016 bp, Homo sapiens
gtaggtagtcaggcagacatgagcagggcaggagagggccctcccccaacgaggaatgtcaagtggccatcagatgatggtcaggcagttgataaactgcttctctcaaataataattggtcgcagccagtgccagggagaggcagtctcccaacagatggaaacacctgaagctggtgatcagcttcccgataagatctcaggagctgggcgagtgggctcaagcatgcacactaagaggcaaaatggcagcgattaactggtagatgaccttcctctaggaacaccggtaagggaaaaacacctcaaatgagcgcgcacataacttcagtaaacacagctgtgcattcggcccctcccaggtgctgacaggccaccgcgcacgcagacagcccgccccaagggaagaatcaggggcgaagagagatgcaaccccccgggagcatgccaacctacaaaaccccgagtcaaaggtcaagccacacacttgcctctctcaagtcacctgcttggccctcttctaagtatactttacttcctttcatgcctactccaaaactttttttttttttttttttttttttttttctgagacggagtctcgctctgtcacccaggctggagtgcagtggcgcaatctcggctcactgcaagctccgcctcccgggttcacgccattctcctgcctcagcctccccagtagctgggactacaggcgcccgccaccacgcccagctaattttttgtatttttagtagagatggggtttctccgtgttagccaggatggtctcgatctcctgacctcgtgatccgcccgcctcggcctcccaaagtgctgggattacaggcgtgagccactgcgcccggcctctaaaacttttaaatacattttcactcctgctctaaaacttgcctctcactctgccttacgcccctcagtcgaattctttcttctgaggaggcaagaactgaggctgctgcagacccatatggatttgctgttgctaacagtac

SEQ ID NO: 492 - DNA, 84 bp, Homo sapiens
tgccccttttcagcaggaagtagccagaaagaatcgtcgtccaacaccccaacagcagttaggtttacttctcttcagggagga

SEQ ID NO: 493 - DNA, 6005 bp, Homo sapiens
gtcaggcctctgagcccaagctaacccatcatatcccctgtgacctgcacatatagatccagatggcctgaagcaagtgaaggatcacaaaagaagtgaaaatggctggttcctgccttaactgatgacattaccttgtgaaattccttctcctggctcagcagctcccccattgagcaccttgtaacccccgcccctgccaccagagaacaacccctttgactgtaattttccactacctacccaaatcctataaaacggccccacccctatctccctttgctgactctctttttggactcagcccgctggcacccaggtgattaaaaagctttattgctcacacaaagcctgtttggtggtctcttcacacggacgcacatgacatttggtgccaaagacctgggacaggaggactccttccagagacttgtcccctgtcctcgtcctcactccgtgaggagatccacccacgacctcaggtcctcagaccaaccagcccaaggaacatctcaccaatttcaaatcggttaagcggtcttttcactctcttctccagcctctcttgctacccttcaatctccctctctcgctatccttcaatctccctgtccttccaattccagttttttttcctctctagtagagacaaaggagacacatttcatccgtggacccaaaactctggtgctggtcacggacttgggaagacagccttcccttggtgtttaatcactgtggggacgcctgcctgattattcacccacactccattgttgcctgatcaccatggggatgcctgccttcattcacccacattcacttggtggcatgtcaatggtgggaatgcctgctttggctgctcacccacactgcagcccagggctgctcaccaccccccttctccatgtctctaccctctcttttctctgggcttgcctccttcactatgggcaaccttccaccctctattcccccttcttctcccttagcttgtgttctcaaaaacttaaaatctcttcaactcacacctgatctaaaacctaaacaccttgttttcttctgcaatgccacttgaccccaatacaaactcgacaattgttccaaatagccagaaaatccactttcaatttctccatcctacatgatctagatagttcttgtcataaaatgagcaaatggtctgaggtgcctgacgtccaggcattcttttacacatcagtccctccctagtctctgttcctaatgcaactcatcccaaatcttccttctttccctctcgcccgtcccctcagtcccaaccccaagcgtcactgagtcttttcaatcttccttttctaccaaccaatctgatctctcccctcttccccagagtgctcctcctcagtttgctccccgccaggctgaatcaggctccaattcttcctcggcctccactccccgacactataatccttctatcacctcccttccttacacctgctctggcttacagtttcattctgagactagccctcccccacctgcccaacaatttcctcttaaagaggtggctggagctaaaggcatagtcaaggttaatgctccttttctttatctgacctctcccaaagcagttagtgtttaggctctttttcatcaaatgtaaaaatccagcccagtttatggcttgtttagcagcaaacttgagaccctttaccaccctagaccctaaaaggtcagaaagccgtcttattctcaataagcattttattacccaatccgctcccgacattagaaaaagctccaaaaattagattccggccctcaaaccccacaacaggacttaactaacttcaccttcaaggcatacaataatagagttagaggcggccaagtagcaacatatttctgagttgcaattccttgcctccactgtgagagaaaccccagccacatctccagcacacaagaacttcaaaacgcctaagccacagtggtcaggcattctttcaggacctcctcccccaggatcttgcttcaagtgccggaaatctggccactgggccaaggaatgcccgcagcccgggatacctcctaagccatgtcccatctgtgcagaaccccactggaaatcggacagtccaactcacccatcagtcactcccagagcccctggaactctggcccaaggctctcggattgacgccttcccagattttctcagcttagcggctgaagactgacactgcccgattgcctcggaagtctcctggaagcctcctggaccatcacatatgctttgggtaactcttacattgagaggtacatctgtcaccttcttaatcaatatggaggctacccactccacattaccttcttttcaagggcgtgtttcccttgcctccataactgttgtgggtactgacgtctgggcttctaaatctcttaaaactccccaactctgatgccaacttggacaatattcttttatgcactcctttttagttatccccaccttcccagctcccttattagactgacacatcttaagcaaattatctgcttccctgatgccacccttcttcccaacccaaagcctccttcacatcttcctctcatatccccctacttctactacctccctggcaactgatcacatgtccattactatcccattaaaccctaatcaccattaccttgctcaacaccagtatcctatcccacaacaggctttaaggggattaaagcctgttatcactcacctgctacagcatgggcttctaaaacttataaactctccttacaattcccccattttacctattcaaaaaccagacaagtcttacaggttagttcaagatctgcgccttatcaaccaaactgttttgcctatccaccctctggtgcccaacccgtacactcttttgccctcaataccttcctccacaactcactattccattcttgatcttaacgatggttttttcactattccactgcacccctcatcccagcctctctttgcctttaccctgacacccatcagtccctgcaaattacctgggctgtactgctgcaaggcttcagggacagccctcattacttcagccaagctctttctcatgatttactttctttccactcctccacttctcaccttattcaatatgttgatgacctactttgtagccctgcctttgaatcttctcaaaaagacaccctcctgctccttcaacatttattctccatgggatatcaagtatctccttccaaagctcaaatttcttctccatccattacctaacttggcatagttcttcatgaaaacccacgtgctctccctgctgatcatgaccaactgatctctcagaccccaaccccttctacaaaacaacagctcctttccttcctgggcatgattggatactttcacctttggatacctgcttttgccatcctaacaaaaccatcacataaactcacaaaaggaaatttagctgaccccatagatcctaaatcctttgcccactcctctttccgttccttgaagacagctttagagactgctcccacactagctctccctgactcatcccaacccttttcattacacacagccaaagtgcagggctgtgcagttggaattcttacacaaggaccaggaccacaccttgtagcctttttgtccaaacaacttgaccttactgttttaggctggccatcatgcctccgtgcggcagctgctactgccataacacttttagaggccctcaaaatcacaaactattctcaacacactctctacaattctcataacttccaaaatctattttcttcctcacacctggtgcgtatgctttctgctacccggctccttcagctatactcaccctttgttgagtctcccacaattactattgttcctggcctggacttcaatccagcctcccacattattctgaataccacacttgacccccatgactgtatctctctgatccacttgacattcattccatttccccatatttccttctttcctgttcctcaccctgatcacacttggtttatcgatggcagttccaccaggccaaatcaccactcaccagcaaaggcaggctatgctatagtatcttccacatctatcattgaggctaccgctctgcccccctccactccctctccgcaagccgaactcattgccttaactagagccctcactcttgcaaagggactacacatcagtatttatactgactctgaatattccgtccatatcctgcactaccatgctgttatatgggcagaaagaggttgcctcactatgcaaaggtcctccatcattaatgcctctttaatgaaaactcttctcaaggctgctttacttccaaaggaagctggagtcatatactgcaagggccatcaaaaggcatcagatcccatcgctcaggacagtgcttaggctgataaggtagctaaagaagcagctagtgttccaacttctgtccttcagtgccagtttttctctttctcactggtcactcccacctattcccccactgaaacgttcacctatcaatctcttcccacacaaggcaaatggttcttggaccaaggaaaatatctccttccagcctcacaggcccattctattctgtcgtcatttcaaaacctcttccatttaggttacaagccactagcccgcctcttagaacctctcatttgctttccatcatggaaatctatcctcaaggaaatcacttctcagtgttccatctgctcttctactactcctcagggattactcaggccccctcccttccctacacatcaggctcagggatttgcccctgcccaggactggcaaattgactttactcacatgccatgagtcaggaaactgaaatacctcttggtctgggtagacactttcactggatgggtaaaggcctttccctcagggtctgagaagtccactgcggtcatttcttcccttctgtcagacataattcttcagtttgggcttcccacctctatacagtccaataacggaccggcctttattagtcaaatcacccaagcagtttctcagtctcttggtattcagtagaaccttcataccccttaccaacctcaatctttaggaaagatagaacggactaatgatcttttaaaagcacacctcaccaagctcagcctccaacttaaaaaggaggactctgtcaaggatagagcccaaaaactcaccaaccaagcaagtaattacactgaaccccttggacactctctaattggatgtcctgggtcctcccaattcttagtcctttaatacctgttttcctctttctccttgtgtcttctgtctagtttctcaattcatacaaaactgtatccaggccatcaccaaccattctatacaaccaatgtcacttctaacaaccccacaatatcaccccttaccacaaaatcttccttcagctaaatctctcccactctaggctcccacattgcccctaatcccactcgaagctgccctgagaaacattgaccattatctctccataccacccccccaaaatttttgctgctctaacacttcaacattagtttatgttatttttcttattaatataagaagacaggaatgtcaggcctctgagcccaagctaagccatcatatcccctgtgacctgcacatatagaatcagatggcctgaagcaagtgaagaatcaccaaagaagtgaaaatggcctgttcctgccttaactgatgactttaccttgtgaaattacttcccctggctcagaagctcccccattgagcaccttgtgacccctgcccctgtccgccagagaacaacccttttgactgtaattttccactacctacccaaatcctataaaatggccccacacctatcttccttcactgactctctttttgaactcagcctgcctgcacctaggtgattaaaaagctttattgctcacacaaagcctgtttggtagtcacttcacacaga

SEQ ID NO: 494 - DNA, 467 bp, Homo sapiens
gcaggagttcagtcagggtggtgggaaaaaatgtagaaagatgcaaaccttggaaggccaaaaggttttacatcagtttcggaacaggatttggctgaaagcagccagattcttttatacggtgcctgaaagcttaggttagataacgggatgttaagaaactgatctagataagttacttagctcggaacctggcctttaatcattcgtaggactgctctctcctgggaggggaaccatgttaattatccacaagtgtgttgactcaaagcctttgccattatatctatactgaataaatgaccacagcaacagctagtcgggaccgcggctgctaactctttacagcaccctcctcagtgtctgtgggtggcccagccccctagctcactctttcactggatacctgtgtttgagtgcatttgttcatctgtcgctgggtcagggtctgcgggtcagacctggca

SEQ ID NO: 495 - DNA, 971 bp, Homo sapiens
gtggggaaaagcaagagagatcagattgttactgtgtctgtgtagaaagaagtagacataggagactccattttgttctgtactaagaaaaattcttctgccttgagatgctgttaatctatgaccttacccccaaccccgtgctctctgaaacatgtgctgtgtcaactcagggttaaatggattaagggtggtgcaagatgtgctttgttaaacagatgcttgaaggcagcatgctccttaagagtcatcaccactccctaatctcaagtacccagggacacaaacactgaggaaggccgcagggacctctgcctaggaaagccaggtattgtccaaggtttctccccatgtgatagtctgaaatatggcctcgtgggaagggaaagacctgaccgtcccccagccggacacccgtaaagggtcagtgctgaggaggattagtataagaggaaggcatgcctcttgcagttgagacaagaggaaggcatctgtctcctgcccgtccctgggcaatggaatgtctcggtataaaacccgattgtacgttccatctactgagacagggaaaaaccgccttagggctggaggtgggacatgcgggcagcaatactgctttgtaaagcattgagatgtttgtgtgtatgcatatctaaaagcacagcacttaatcctttaccttgtctatgatgcaaagacctttgttcacatgtttgtctgctgaccctctccccactattgtcttgtgaccatgacacatccccctctcggagaaacacccacccacgaatgatcaataaatactaagggaactcagaggctggcgggatcctccatatgctgaacgctggttccccgggtccccttatttctttctctatactttgtctctgtgtctttttcttttccaagtctctcgttccacctcacgagaaacacccacaggtgtggaggggcaacccatcccttca

SEQ ID NO: 496 - DNA, 469 bp, Homo sapiens
tcccggccccacaccaggaaggtcaggtgaccatcaagcacccgtcaggcagttgttaagctgtctccctaaaataacaattggtcgcagccggggccaaggaaaggcagtctgccaatagatagaaacacctgaaactggtgaccagcagcttcctgataagatctcaggagttgagccagtggactcacccgtgtgctctaagaggcagaatgggaagtttaactggtatataacctttctgtaggaatgctagactggtaagggaagaatgcccgaagtgagcatgcgtacaactccagtaaacacattgcgcatgaagcccctcccaaggtctagcaggccactgtgcatgtggaaagcccatcctaagggaagaatcaaggcagaagaggctcaagaccccggaagtatgccaatgtgcaaaaccccaagtcaatgatcagacagtgcacttgatctcttaagt

SEQ ID NO: 497 - DNA, 132 bp, Homo sapiens
tgccaacgtataaaaccccaagtcaaaccacacacttgactctctcaagtcacccacttagtcctcttccaagtgtattttacttcctttcattcctgctctaaagcttttaaataaatattcactcctgct

SEQ ID NO: 498 - DNA, 1900 bp, Homo sapiens
aaggttggcctcattgtttacaggtagtggcagcagtagcagtcttagtatctgaagcagttaaaataatacagggaagagatcttactgtgtggacatctcatgatgtgaacggcatactcactgctaaaggagacttatggctgtcagacaaccgtttacttaaatatcaggctgtattacttgaagggccagtgccgcaactgcgcacttgtgcaactcttaacccagccacatttcttccagacaatgaagaaaagatagaacataactgtcaacaggtgattgctcaaacctacgctgctcgaggggaccttctagaggttcccttgactgatcccgacctcaacttgtatactgatggaagttcctttgtagaaaaaggacttcaaaaagcggggtatacagtggtcagtgataatggaatacttgaaagtaatcccctcactccaggaactagtgctcagctggcagaactaatagccctcactcgggcactaggattaggaaaaggagaaagggcaaatatatatacagactttaagtatgcttacctagtcctccatgcccacacagcaatatggagagaaagggaattcctaacctatcaaacatcaggaagccattaggagattattattggctgtacagaaacctaaagaggtgacagtcttacactgccagggtcatcaaaaaggaaaggaaaggaaaatagaagggaactgcccaggggatattggagccaaaagagctgcaaggcaggaccctccattagaaatgcttatagaaggacccccagtatgaggtaatcccctccaggaaaccaagccccagtactcagcaaaagaaatggggaacctcacgaagacatagtttcctcccctcagcatggctagccactgaaaaaggacaaatactttttcctgcaactaaccaatggaaattacttaaaaccttcaccaaacctttcacttaggcattgatagcacccatcagatggccaaattattatttagtggaccaggcctattcaatactatcaagcagatagtcagggcctgtgaaatgtgccaaagaaataatcccctgcactttaggccatacatttcaatccctgcatctttagcctccttgttaggtttgtctcttccagaatcaaagctgtaaaactacaaatggttcttcaaatcgagccccagatgcagtccatggcagatctaccatggacccctgaaccggcctgctagcccttgctccaatgttgatgatatcaaaggcacccttccctaggaaatctcaactgcatgacccctactactccccagttcagccggaagcagttagagtggtcatcagccaacctccccaacagcacttgggttttcctgttcagatgggggactgagagacaggactagctggatttcctaggccaactaagaatccctaagcctagctgggaaggtgaccgcaaccacctttaaacacggggcttgcaacttagctcacacccgaccaatcaggtagtaaagagagctcattaaaatgcgggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaaaataaaaaaaaaaataaaataaaatgctaattaggcaaaaacaggaggtaaagaaatagccaatcatctattgcctgagagcacagggagaggggcaatggtcgggatataaacccaggcattcgagccggcaatggctaccccctttggttcccctcccattttatgggagctctgttttcactctattaaatcttgcaactgca

SEQ ID NO: 499 - DNA, 652 bp, Homo sapiens
ttacagtaggtaggcagacatgagcagcgtgggaggggtcccccccaccacccccaacaggaatatcaggcgaccatcaggagatgatggtcaggcagttcttaaatgtctctctaaaataataattggttgcagccagcgccagagaaaggcagtctcctagtagacagaaaacacctgaaactggtgatcaacagcttcccgataaggtctcaggaactgcgtgagtgggctcgagcatgtgcacgaagaggtaaaatggcagagtttaactggtatatgaccttcctctaggagcactcgactggtaaggaaagaatgcctttagtgagcatgcgcacaactttagtaaacacactgcacatgcggcccctcccacgtgctggcaggccagtgtgcaggcggacagcccaccccaggggaagaatcaggggagaagtaacgcaaccccagaagcacactcaatgtactaaaccccaagtcaaaggtcaaactatgtacttgatctctaaagtcacccacttggccctccaagtgtacttccttttgttcctgctctaaagctttttaacaaactttcactcctgctctaaaacttgcctgggtctctcagtctgcctaatgcccctgggtcaaattctttcttctgagg

SEQ ID NO: 500 - DNA, 138 bp, Homo sapiens
ctgaaatatgtccaaaatgtaaaagaggaaaacactggactaatcagtgtcactctaaatttgataaagatgggaacccgatttcaggaaacaccatgaggggtccctcctgggccccgttctaaaccggggcattcc

SEQ ID NO: 501 - DNA, 3844 bp, Homo sapiens
tgggacaatagttatcagctcaacagaaacagtatttaaaagtattgaaacagctgctaaagctagtggagcctcgctttcacagtctcaattaaaggacctaatccaaacttttgtatcccataacccatagctccctgaagaaggtatgctagacatacagctctgggaacaagtgaggagaaatcttaaacaacatcacatgcaagggcaatgggtcccagtaacatctttaatgttatggacttaaattagggcagttttggtcctgttatacacagaagagcctaagaaggggagggaggaagaacctaccttactgcctccttaaccctcagccctgctatcaccaggccaaaatcacaaagaggagatggaggttttgcctgagccccctcgtctagtaaattagaaaaaagacatgggataggctacagctatgggaccctgtcttaggcaagtggcattagaaggggagctcttcgtctgcccagttatgctagatcaataaggcaaacagataaaaaggggcattagagaagatgaagccactagcccatttacaagagggttaattgaggtcactctgcagacctctttctgataatggccaccgttatttctcccctacccctgatgtggctctcttaaaatcctatttgagtaaaacagtggcctttaaagggagagaaattacaaagagcccatgaattagttgaggagcaattaaaagtcggccatatagaactgtcaaacagccctgggaatttgcccattttcgtcattcccaaaaagtctggtaaatggagacttttgcatgacttacacgctattaatgctaatttgcaaactatggggccccttcagcaggggctcccctcccctacggcgattcctcaagactggtctataatcattattgacttaaaagactgcttttatactattccacttgcaaagcaagacagagaaaaatttgcatttacaataccagctatcaataatgaaaggccagcttgccaatttcactggaaagtgcttcctcaaggaatgctgtacagtcctaccatgtgtcagtatcatgtaaatcaggctttgctccccagtaaaaaaaaaaaaaaaaaaatcctaattgcaagattattcattttatggatattttactagcaaccccaatgcagccaatgcttttaagtttatgtacgtctgtcatgaagaatacacagttaagaggtttaatcatagcacctgaaaaactacaaatgtcctctccttggaaatattttggatacatactaactttccagtcagtaagacctcaaaaggttaaattaaatactagcaacttacacaccttaaatgattatcagaaattactaggcaatattaactgacttcatcccaccttgggcataactactgatacagaacctcttttttatcttaaagggcaatacagccctagactctcctagatatttaactcctgcaacacaaagggaaatggaagagatagaacaagctatctctcaaaggcaactagaacacattgacccatggtattcagtacaattatttatgtttcctaccaaacactccgctacagggttaataggacagatggccccagagctatgctttctagaatgggttttttgttcacataccgggactaagacactctctccccatatccagttcgtcagtaaagtcatctattcaggctgcagaagatgcaatcagttgctaggttatgaccctgatatcatcaggattcctttaagtaaaaggcaatttgaagcagtattgcccttatctgtggacctgcaaatagcactctctgattacacaggtcatatagagcatgcccttcctgctgacaaactccttcagttcttatctcacacttttgtggttttgcctaaaaaaaaattcaatcccccatacctaacggctttaacactgtttactgatggctcgcttaaacatggaaaagtggctgtctggtggaggccacagaatttcctcactggttccggatttactaacattcaaagagctgaggttggagccttaatattggctctggagactttttccactcagcccatcaatattgttagtgactctgcttactctgtttatattttgcagaaccttgagacagccctcattaagtccactctggagcccaccctatgtgctctttttctctgacttcagcatttgctagatcaacatacacatcctatttttatcagacatattcaagcccacagctcacggcctggcccagtggcttatggcaatgatcaagcagacctacaggttatgacatcactgcttgaccaagccacccaatcgcatcaattttccaccaaaactggagaaacttatctaaacaatttcaacttacccagagactagctaaacaaatcatcctgcaatgcccagattgccagcttacaggcacatccccccccttcaacaggtgttaaccctagtggactggaacctaatcagttatggcaaacagatgttactcacatccctgaatttggaaaacttagatatgtacatgtatccattgataccaattctcacttaatcagcacccatgctttgcctggagaatccacctgatatgttgttaaacatcttcttttaacttttgcatttatggggtggcccacaaaaattaaaactcataatgatccagcttatgccagctcacaattttaacaattttgtcacacgtggaacatccaacattccacaggcatcacatataacccccaaggacaggccatacaacgtgtccattccactcttaaaaacatcctcaaaaaacaaaaatgggggaatatgagtaaggaccctgcaacactattggcacaagccttatttacccttaatttttaaaatgtagatgataaatttcaattagctgtagaaaagtactttgctaaaacctttcaagacataaaacccacagttttatggaaagatgtaaacagtaatgtatggtgtggtccaaatgaatgcttaacatgggaaagagaatatgcttgtgttcacaacccctcaggtcctctttggattccagcacgatgcatcaaaccataccatggtgtggctaggacccaacctggtaccagaaatgaagaaaatgaccctatgggacccatagccccagacgatgtggcttcctcagatgacacaagccccagacatcacctgatggatgctgaagaagacaactcaaaaggcccaacacatcctgctctagatacagacaccgtttactccagataacatgttcctttttatgctcattttgcctgctacctgtacctacactttattaagcccatcttctaaatccaccttttttcagccctgttacttaggcaaacacccgctcccagcaactgacaacgtgactgcttggctaagaggaattaacatacccccagtggggttcctcagcaacagccatatgaaaggatatgcaaaaacatctctcttggatagacctcccactcctaggggtcactcctcaattggaaaagaatgttgctaattatactcatgtttgttttatgttacttaataattctaggatgcaaagccagagtacaagttataaccgctgtacctgacaagcctgttgctgcacacatttgcactcttcaatcaacaaagcctaatgcagaaaaacagaaaagggggagatgtgggagatcattcacggtagtgggagaaattacaggaatagaagcaaaccttcttgaagggctgggtgtgggttgcaaaagctttgaaagataatttggctgaaggc

SEQ ID NO: 502 - DNA, 6312 bp, Homo sapiens
gtcaggcctctgagcccaagccaagccatcgcatcccctgtgacttgcacgtgtatgcccagatggcctgaagtaactgaagaatcacaaaagaagtgaaaatgccctgccccaccttaactgatgacattccaccacaaaagaagtgtaaatggccggtccttgccttaagtgatgacattaccttgtgaaagtccttttcctggctcatcctgaggcaaaaagcttccccacggagcaccttgcgacccccactcctgtccaccagagaacaaacctcctttgactgtaattttcctttacctaaccaaatcttataaaacggccccacccctatctcccttcgctgactcttttggactcagcccacctgcacccaggtgaaataaacagccatgttgctcacacaaagcctgtttggtggtctcttcacacggacgctcatgaaatttggtgccatgactcggaccggggaacctcccttaggaaatcaatcccctgtcctcctgctctttgctccatgataaaggtccacctatgacctcaggtcctcagaccaaccagcccaagaaacatctcaccaatttcaaatccagtaagtggcctctttttactctcttctccaacctccctcactatcactcaacctctttctcctttcaatcttggcaccacacttcaatctctcccttctcttaatttcaattcctttcattttctggtagagacaaaggagacacgttttatccgtggatccaaaactccggcgccggtcacagactagggaaggcagccttcccttggtgtttaatcattgcagggacgcctctctgactattcacccaggtttcagaggtgtcagaccactcatggacgcctgccttggtctttcacccttagtggcaagtcctgcttttctgggggaggggtaagtaccccaaccccttctctccatgtctctaccccttttttgcttttctgaggcaggggcaagaacccctcaaccccttctccttcacgcttagtggtaagtcccgcttttctagggggcaagaacccccaatcccttatttccacgccccgacctcttatctctgtaccccaatcccttatttccatgccccaacctcttatctctgcaccccgatcccttatttccatggcccgacctcttacctctacaccccaatcccttatttctgcaccccgacctcttatctctgcgccccatcccttatttccatgccccgacctcttatctctgcacctcaaccccttatttccacgatccgacccctttcccgcttttctggagggtaagaacccccgaaccccttccctccttgtctctactctctcttttctctgggctttcctccttcactacgggcaaccttccaccctccattcctccatctcccttagcctgtgctctcaagaacttaaaacctcttcagctcacacctgacataaaacctaaatgccttattttcttctgcaatgccgcttgaccccaatacaaactcgacagtagttccaaatagccagaaaatggcactttcaatttttccatcctgcaagatctaaataattcttgtcataaaatagcaaacagtctgatgtgcctgacgtccaggcattcttttacacatcagtcccttcctagtctctgtgcccagtgcaactcgtcccaaaccttccttctttccctcccgcctgtcccctcagtcccaaccccaagcgtcactgagtctttctaatcttccttttctacagacccatctgacctctcccctcctccctgggctgctcctcgccgggctgagctaggtcccaattcttcctcagcctccactcctccaccctataatccttttatcacctcccctcctcacaccccgtccggtttacagtttcattccgtgagtagccctcccccatctgcccagcaatttactcttaaaaaggtggctggagctaaaggcatagtcaaggttaatgctcctttttctttatcccaaatcagatagcgtttaggctctttttcatcaaatataaaaacccagcccagttcacggctcgtttggcagcaaccccgagacgctttacagccctagaccctaaaaagtcagaaggccgtctattctcaatatacattttattaccctatctgctcccaaaaattaaataaaaatccaaaattaaatccaaatccaaataaataaaatccaataaataaaaatccaaaaattaaattccagccctcaaacccaacaggacttaattaacctcgccttcaaggtgtacaataatagaggcagccaagtagcaacatattcctgagttgcaattccttgcctccactgtgagacaaaccccagccacatctccagcacacaagaacttccaaatgcctaaaccgcagtggccaggcgttcctccagaaccaccttccccaggagcttgctacaagtgccagaaatctggccaccaggccaaggaatgcccgcagcccgagattccccctaagctgtgtcccatctgtgcgggaccccactggaaactggactgttcaactcacctggcagccactcccagagcccctggaactctggtccaaggctctctgactgactccttcccagatcttcttggcttagcaactgaagattgacgctgcccgatcaccttggaagccccctggaccatcaccaacgccaagctttaggtaactctcacagtggagggtaagtccatcccctgtttaatcgatacgggggctacccactccacgttgccttcttttcaagggcctgtttccctcgccccaataactgttgtgggtattgacagccaagcttcaaaacccctgaaaactcccccactctggtgccaacttggacaacactcttttatacactcttttttagttatcctcacctgccccgttcccttattaggccgagatattttaaccaaattatctgcttccctgactattcctggactacagccacatctcattgccgcccttctccccaacccaaagcctccttcgcatcttcctctcatatccccccaccttaacccacaagtatgggacatctctactccttccctggcaaccgatcacatgcccattaccatcccattaaaacctaatcacccttaccccgctcaatgccaatatcccatcccacagcacgctttaaaaggattaaagcctgttatcactcacctgctacagcatgggcttctaaaacctataaactctccttacaattcccccattttacctgtccaaaaaccggacaagtcttacagattagttcaggatctgcgccttatcaaccaaattgttttgcctatccaccctgtggtgcccaacccgtacattcttttgtcctcaatacctccctccacaactcactattccgttcttgatcttaaagatgcttttttcactattcccctgcacccctcatcccagcctctctttgctttcacctggattgaccctgacacccatcagtcccagcagcttacctgggctgtgctgcctcaaggtttcagggacagccctcattacttcagccaagctctttctcatgatttactttatttccacccctctgcttctcaccttattcaatatattgatgaccttctttgtagcccctcctttgaatcttctcaacaagacacacttctgctccttcagcatttattctccaaaggatatcgggtatccccctccaaagctcaaatttcttctccatctgttacctatctcggcataattcttcataaaaacacctgtgctctccctgccgctcatgtccaactaatctctcaaaccccaacccttctacaaaacaaccccttccttcctgggcatggttggatactttcacctttagacacctggttttgccatcctaacaaaaccattatataaactcacaaaaggaaacctagttgaccccatagatcctaaatcctttccccactcctctttctgttccttgaagacaactttagaaactgccccctctctagctctccctgactcatcccaacccttttcattacacacagctgaagtgcagggctgtgcagtaggaattcttacacaaggaccgggatcgcatcgtgtagcctttttgtccaaactacttgaccttactgttttaggcttgccatcatgtctctgtgcagcagctgctgctgccctaatacttttagaggcccttaaaatcacaaactatgctcaactcactctctacagctctcataatttccaaaatctatgttcttcctcacacctgacgcatatactttctgctctccggctccttcagctgtactcactctttgttgagtctcccacaatcaccattgttcctggccccaacttcaatctggcctcccacattattccggataccacacctgcccctcatgactgtatctctctgatccacctgacgttcaccccatttccccacatttccttcttctctgttcctcaccctgatcacacttagtttattgatggaagttccaccaggcctaatcgccacacaccagcaaaggcaggctatgctatagtacaagccactagcccgcctcttagaacctgtcatttcctttccatcctggaaatctcaaggaaataacttctcagtgttccatctgctattctactactcctcagggattattcaggccccctcccttccctacacatgaagctcagggatttgcccccacccaggactggcaaattagctttactcaacatgccctgagtcaggcaactaaaatacctcttagtctaaatagacactttcactgaataagtaaagacatttcctacagggtctgagaaggccaccgtagtcatttcttcccttctgtcagacacaattcctcagtttggccttcccacctctatacagtccaatagcagaccagcctttattggtcaaatcagccaagcagtttttcaggctcttagtattcagtgaaacctttatatcccttacagttctcagtcttcaggaaaagtagaacagactaatggtcttttaaaaacacacctcaccaagcccagccaccaacttaaaaaggactggacaatacttttaccactttcccttctcagaagtcagacctgtcctcagaatgctacagggtacagcccatttgagctcctgtatagacgctcctttttattaggccccagtctcattccagacaccagaccaacttagaccgtgcccccccccaaaaaaacttgtcaaccctactatcttctgtctagtcatattcctattcaccgttctcaactactcatacatgccctgctcttgtttacactgccagtttacactgtttctccaagccatcacagctgatatctcctggtgctatccccaaactgctactcttaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaactgtatccaggccatcaccaataattctacacaacaaatgtttcttctaacaaccccacaatatcaccccttaccacgaaatcatccttcagcttaatctctcccactctaggttcccacaccgcccctcatcccactcgaagcagccctgagaaacattgcccattatctctccataccaccccccccaaaatttttgccgcccccacacttcaacactattttatttttcttattattataagaaggcaggaatgtcaggcctctgagcccaagccaagccatcgcatcccctgtgacttgcacgtatatgcccagatggcctgaagtaactgaagaatcacaaaagtgaaaatgccctgccccaccttaactgatgacattccaccacaaaagaagtgtacatggcctgtccttgccttaagtgatgacattaccttgtgaaagtccttttcctggctcatcctggctcaaaaagcacctccactgagcaccttgcgacccccactcctgcccgccagagaacaaaccccctttgtaattttcctttacctacccaaatcttataaaatggccccacccctatctccctttgctgactctctttttggactcagcccgcctgcacccaggtgaaataaacagccatgttgctcacacaaagcctgtttggtggtctcttcacgcggacgctcatgaaa

SEQ ID NO: 503 - DNA, 741 bp, Homo sapiens
gtggggaaaagaaagatcagattgttaccgtgtgtatgtagaaaaggaagacataagaaactccatgttgatctgtacaaagaaaaattgtttctgctttgagatgctgttaatctgtaactttagccccaactctgtgctcacaaaaacatgtgctatattgaatcaaggtttaagggatttagggctgtgcaggatgtgccttgtcaacatatgtttgcagacagtatgcttggtaaaagtcatcgtcattctccattctctattaaccagggacatgatgcactgtggaaagccgcagggacctctgcccaagaaagcctgggtatttgtccaaggtttccccccactgagacagcctgagatatggcctcgtgggaagggaaagaccttactgtcccccagcccgacacctgtaaagggtctgtgctgaggaggattagtaaaagaggaaggcctctatttcccgcacatccctgggaacggaatgtctcggtgtaaagccgactattggttctatttactgagataggagaaaaccgccctgtggctggaagcgaaatatgctggcagcaatactgctctgttactctttgctacactgagatgtctgggtaaagagaaacaaaaatctagcctacatgcacatctcagcacagtaccttcccttgaacttatttatgatgcagattcctttactcacatgttttcctgctgaccttctccccaccatcaccctgt

SEQ ID NO: 504 - DNA, 8212 bp, Homo sapiens
gtcaggcctctgagcccaagctaagccatcatatcccctgtgacttgcacgtatacatccagatggcctgaagcaagtgaagagtcacaaaagaagtgaaaatggctggttcctaccttaactgatgacattcaaccattgtgatttgttcctgccccaccttaactgagcaattaaccttgtgaaattccttctcctggctcagaagctcccccaccgagcactttgtgacccccgcccctgcccacaagagaaaaaccccctttgactgtaattttccactacccacccaaatcctataaaactgtcccacccctatcttccttgctgactcctttttcggactcagcccttctgcacccaggtgaaataaacagccttgttgctcacacaaagcctgtttggtggtctcttcacacggacatgcatgacatttggtgccatgactcagattgggggacctcccttgggcgatcaataccctgtcctgctctttgctccatgagaaagattcacctacgacctcgggtcctcagaccaaccagcccaaggaacatctcaccaattttaaatcaggtaagtggcctatttttactctcttctccaacctctctcactatccttcaacctctttctcctttcgattttggcaccacccttcaatctctcccttctcttaatttcagttcctttccttttctggtagagacagaggagatgcgttttatctgtgaacccaaaactccagctctggtcacggactcaggaagacagtcttctcttggtgtttaatcactgtggggacgcttacccacgtttcagaggtgtctgatcaccagggggatgtctggccttgatccttcaccttggtggccagtaccactttcactgggtggcaagcaccacctcccctggggggcaagtaccctcccaccccttctctccatgtgtctactctctcttttctctgggcttgcctccttcactatgggcaaccttccaccctccattcctccctcttctcccttagcctgtgttctcaagaacttaaaacctcttcagctcacacctgacctaaaacctaaatgccttattttcttctgcaacactgcttggccccaatacaaacttgataaatgctctaaatggccagaaaacagcactttcaatttctccatcctacaggacctagataatttttgtcgaaaaattggtaaatggcctgagatgccttacatacaggcattttttcacacttcgttccctccctagtctctgttcccaatgcaattcgtcccaaatcctccttctttccctaccgcctgtcccctcagtcccaaccccaagcattgctgagtctttccaatcttccttttctaccaagccatctgacctctcccctcctccccagactgctccctatgttgctttctgccaggctgaatcaggctccaaatcttcctcagcctctgctcctccaccctataatccttttatcacctcccctcctcacacccagtccagcttacagttttgttccatgactggctctcccctacctgcccaacgatttcctcttagagaggtggctggagctgaaggcatagtcagggtacttgtgcctttttctctatcagacctctctcagatcagtcagtgtttaggctctttctcatcagaccccactaattatatataggaattccagtatctaactctgtcctgcaatttaacctggagtgatttaaatgtcatcctaacatctaccctttccccagatgaacaggaaagagttttttctctagcccaatctcacactgataaccaccggcttcacaagccagacctccaagaaggcattagagcagttccccaagatgatccccaatggaactatcaggcagattccccaggtataattaggcgagattacatgatttcctgcctagttgatgggcttacaaaggcagtttacaaagctgttaattttgacaagcttaaagaaactacccaaggtaaagacaaaaacctagcccagttcctggcttgtttggcagcaaccctgagatgctttacagccctagaccctgaagggtcagaaggccgtcttattctaaataggcattttatcacccagtcagctcctgacattagaaaaaagcttcaaaaattagaatccagccctcaaaccccacaacaggaattaatcaacctcaccttcaaggtgtacaataatagagaggaggcagccagacagcaacgcatttctgagttacaattacttgcctttgctgtgagacaaaacccagccacacctccagcacacaagaacttcaaactgcctaagccgcagcagtcaagcattcctacaggacctcctccaacaggctgttgcttcaagtgccagaaatctggccactgggccaaggaatgcctgcagcccaggattcctcccaagccatgtcccatctgtgcagggacccactggaaatcagactgcccagctcacccggcagccactcctagagcccctaaaggtctggcccaaggctctctgactgactgcttcccagatttgcttggcttggcagctgaagactgacgctgcctgatcaccttggaagccccctggaccatcatggatgctgagctttgggtaactctcacagtggagggtaagtccgtcccctgtttaatcaacacaggggctacccactccacattaccttcttttcaagggcctgtttcccttgccctcataactgttgtgggtattgacggccaagcttcaaaaccccttgaaactcccccactctggtgccaacttggacaacattattttatgcactcttttttagttatccccacctgcctagttcccttaatttttttattttttattttttgagatggagtcttgctctgtcgcccaggctggagtgcagtggcgcgatctcagctcactgcaagctccgcctcctgagttcatgccattctcctgcctcagcctccagagtagctggaactacaggtgcccaccaccacgcccagctaattttttttttttttgtatttttagtagagatggggtttcaccgtgttagtgaggatggtctcgatctgctgacctcgtgatccgcccacctcggcctcccaaagtgctaggattacaggcgtgagccaccgtgcctggccccagttcccttattaggccaagacattttaaccaaattatctgcttccctgactcttcctggactacagccaaatctcattgtcacccttcttcccaacccaaagcctccttcatgtcttcccctcgtatccccctaccttaacccacaagtatgggacacctctaccccctccctggcaaccgatcacacacccactactatcccactaaaatctaatcacccttaccccactgaacgccagtatcctatcccacaacaggctttaaggggattgaagcctgttatcactcacctgctacagcatgggcttctaaaacctataaactcttcttacaattcccacattttacctgtccaaaaacgggacaagtcttacaagttacttcaggatctgcaccttatcaaccaaattgttttgcctatccaccccgtggtgccaaacccatatactgtcttatcctcaatacctccctccacaacccattattctgttctgcatctcaaacatgctttctttactatttctttgcacccttcatcccagcctctcttcgctttcacatagactgaccctgacacccatcagtctcagcaacttacccgggctgtactgctgcaaggcttcaccgacagcccccattacttcagtaaagtcctttctcatgatttactttctttccatccatctgcttctcaccttattaaatattttgacaactttctactttatagcccctcctacaaaacttcccaacaggacacccttctgctcctccaacatctattctcaaaaggatattgtgtatccccctccaaagcccaaatttcttcctcatccattacctatctcggcataattcttcataaaaacacatgtgctctccctgctgatcatgtccagcttatctccaaaaccccaaccccttctacaaaacaacaactcctttccttcctaggcatggttaggtacttctgcctttggatacctagttttaccatcctgactaaaccattatataaactcataaaaggaaacctagctgaccccataaatcctaaatcctttccccactcccctttccattccttaaaaaacagccctaaaaactgtcccacactagctctccctaactcatcccaacccttttcattacacacagccaaactacagggctgtgcggtaagaattcttacacaaaagctgggaccacaccgttagcctttctgtccaaacaatgtaaccttactgttttagcctagcactcatatctgtgtgtggcagctgctgctgcattaatacttttagaggccctcaaaatcacaaactatgctcaactcactctctacagttctcataacttccaaaatctatttttttcctcaaatctgacgcatatactttatgctccccagttccttcagctatactcactctttgttgagtctcccacaattaccattgttactggcctggacttcaatccggcctcccacctcattctggatgccacacctgacccccatgactgtatctctctgatccacttgacattcacttgatttccccatatttccttctttcctgttcctcaccctgagcacacttggtttattgatagcagttccaccaggcctaatcgccactcaccagcaaaggcaggctatgctatagtatcttccacatctatccttgaggctaccactgtgccccactccactacctctcagcaagccgaactcattgccttaactcgagccctcactcttgcaaagggactatgcatcaatatttatactgatgctaaatatgccttccatatcctgcaccaccatgctgttatatgggcagaaagaggtttcctcactatgcaagggtcctccatcattaatgtctctttaataaaaactcttctcaaggccactttacttccaaaggaagctggagtccttcattgcaagggccctcaaaaggcatcagatcccatcgctcagggcaatgcttatgctgataaagtagctaaaaaagcagctagcattccaacttctatccctcacagccagtttttctccttctcatcgatcactcccacctactctcccactgaaacttccacctatcaatctcttcccacacaaggcaaatggttcttggaccaaggaaaatatctccttccagcctcacaggcccattctaatctgccgtcatttcataacctcttccatgtaggttacaagctgctagcctgtctcttagaacctctcatttcctttccatcatggaaatctatccttaaggaaatcacttctcagtgttccatctgctgttctgctactcctcagggattgttcaggccccctcccttccctacacatcaagctcagggatttgcccctgcccaggactggcaaattgactttattcacatgccctgagtcaggaaactaaaatacctcttggtctgagtagacacttgtaatggatgggtagaggcctttcccacagggtctgagaaggccactgccatcatttcttcccttctatcagacagaattcctcaatttggccttcctacctctatacagtctgataacggaccagcctttattagtcaagtcactcatgcagtctcccagtccctaggcattcaatggaaacttcatgctccttattgccctcaatcctcaggaaaggtagaaagaactaatggtcttttaaagacacacctcaccatactcagcctccaacttaaaaaggactgaggccgggcgcggtggctcacccctttaatcccagcactttgggaggccgaggtgggcggatcacgaggtcaggacatcctggctaacatggtgaaaccctgtctctactaaaaaatacaaaaaaaattagccaggcatggtggcaggcccctgtagtcccagctactcgggaggctgaggcaggagaatggcgggaacctgggaggcagagcttgcagtgagctgagatcacgccactgcctgggacacaagtgagactctgtctcaaaaaaaaaaaaaaggactgaacagtacttttaccacttgcccttctcagaattcaggcctgtcctcaagatgccacagagtacagcccatttgagcttctgtatggatgctactttttattaggccccagtctcattccagacaccagccctctaggtgattatcttccagtcctccagcaggctagacaggaaatttgccaggctgctaatcttctcttgcctactccagattcccagccatatgaagacaccctagctggacgatcagttcttgttaagaatctgacccctcaaactctacaaccttgaggggccagaccctacttagtcatctatagtaccccaactgccgtctgcctgcagggccctccccattaggttcactgatccagaataaagctgtgtccatcggacagccagcctgatctctcatcttcctcctgggagttacatgtactctctcctacttcccttaaactcacctgcattcctaaaggataatagtaacccttataaggctaatacatcctttcatttttattaggtctcaccttccttaccatactctttataacagggctttacacagtcacccccactacttggactgcaccccaaaaatttgtcatccttactatcttccgtctagtcatactcctattcaccattctcaactacttgtaaatgccctgcccttgtttatactgccggtttacacttttcctccaaatcatcgtagcggatatctcctgatactatccccagtctgccactcttgactccctcttggagtggatgggtgatctttgctgacagggcacactgatacttccaccctgaagaagtcctattctttacttttatactcactctttttctcgttcctgttcttacgccaccctctacctctccctagctatctccaccatgctatcaatctcactccactctctcctagccatttctaatccttctttaacaaacaattgctggctttgcatttctctttcctgtgaaatcaccgaggcctcgacttactcactgctaaaaaaacaggactctatatttttaaatgaagagtgttgtttttacctaaatcaatctgtcctggtgtatgacaacataaaaaatctcaaggatagagcccaaaaactcaccaagcaagcaagtaattacactgaaccccttgggcactctctaattggatgtcctgggtcctcccaattcttagtcctttaatacctgtttttttccttctcttattcggaccttgtgtcttccgtttagtttctcaattcatccaaaactgtatccaggccatcaccaatcattctatatgacaaatgctccttctaacaaccccacaatatcacctcttaccataaaatcttccttcagcttaatctctcccactctagattcccacgccactcctaatcccgctcgaagcagccctgagaaacattgccaattatctctccataccacccccccaaattttctctgccccaacacttcaacattattttatggttttttcttattaatataagaaaacaggaatgtcaggcctccgagcccaagctaagccatcttatcccctgtgacctgcacatatacatccagatggcctgaaacaagtgaagaatcacaaaagaagtgaaaatggccagttcctgccttaactgatgacattctaccattgtaatttgttcctgccccaccttaactgagtgattaaccttgtaaaattccttctcctggctcggaaactcccccaccgagcactttgtgaccaccgcccctgcccacaagagaaaaaccccctttgactgtaattttccactacccacccaaatcctttaaaacggccccacccctatcttccttgccgactcctttttcggactcagcccacctgcacccaggtgaaataaacagctttattgctcacacaaagcctgtttggtggtctcttgacacgga

SEQ ID NO: 505 - DNA, 984 bp, Homo sapiens
gtagggaaaagaaagatcagactgttactgtgtctatgtagaaaaggaagacataagaaactccattttgatctgtactaagaaaaattgttttgccttgagatgctgttaatctataactttagccccaaccctgtgctcacagaaacatgtgctgtatggaatcaaggtttaagggatctagggctgtgcagggtgtgccttgttaacaatatgtttacaggctgtatgcttggtaaaagtcatcgccattctccattctcgattaaccaggggcataacgaactgcggaaagccgcagggacctctgcccaagaaagcctgggtattgtccaaggtttcccccaactgacacagcctgagatatggccttgtgggaagggaaagacccagccgtcctccccagcctgtcacccgtaaagggtctgtgctgaggaggattagtaaaagaggaaggtctcttgcggttgagataagaggaaggcctccatctcctgcatgtccctgggaatggaatgtctcggtgtaaaacccgatcgtaaattcctcctattctgaggtaggagaaaaccgccctgtggctggaggcgagatatgctggcagcaatgctgctctgttactctttgctacactgagatgtttgggtggagagaagcaaaaatctggcctacgtgcacatccgggcacagtaccttcccttaaacttatttgtgacacagattcctttgctcacatgttttcctgctgaccttctccccattatcaccctgttctcctgccgcattcccctagccgagatagtgaaaatagtaatcaataaatgctgaaggaactcagagaccggggcctgtgcaggtcctccatatgctgagcgccggtcccctgggaccactgttctttctctatactttgtctctgtgtcttattccttttctcagtctctcgttccacctgacgaggaatacccagaggtgtggaggggc

SEQ ID NO: 506 - DNA, 965 bp, Homo sapiens
gtggggaaaagaatgagagatcagattgttactgtgtctgtgtagaaaaggaagacataagaaactccactttgatctgtactaagaaaaactgttctgttttgagatgctgataatccataactttagcctcaaccctgtgctcacagaaacacgtggtttaatggatttagggctgtgcagcatgtgccttgttaaccatatgtttgcaggcagtatacttggtaaaagtcatggccatcctccagtctcgattaaccagggacacaatgcactgcggaaagccgcagggacctctgcccgagaaagcctgggtattgtccaaggtttcccccactgagacagcctgagatatggcctcatgggaaaggaaagactttaccatcccccaacccgacacccgtaaagggtctgtgctgaggaggaggagtgaaagagggaggcctctttgcagttgagataagaggaaggcttctgtctcctgctggtccctgggaatggaatgtctaggtgtaaagctgaccattcccattcattccattctgagataggagaaaattgccctgtggctggaggcgagatatgctggcagcaatactgctctgtgactctttgctacactgagatgtttggatgaagagaaacataaatctagcctacgtgcacatacgggcacagtacctttccttgaacttattcatgatacagattccttcgctcacatgtttctctgctgaccctctccccacctgttgcccagccacattcccctcgccaagatagtaaaaatagtgatcaataaatactgagggaactcagagaccagcgccagtgcgggtcctcgcacgttaagcgtctgtcccctgggcccactgttctttctctatactttgtctctgtgtcttgtttcttttctgagtctctcatctccacctgactagaaatacccacaggtgtggaggggc

SEQ ID NO: 507 - DNA, 5827 bp, Homo sapiens
gtcaggcctctggtcccaagcctgcacatatacatccagatggcctgaagtaactgaagaatgacaaaagaagtgaaaatggtcggttcctgccttaactgatgacattaccttgtgaaataccttctcctggctcatcctggctcaaaagctcccccactgagcaccttgtgacccccacacctgccagccagagaataactcccttttactatacttttccactacctacccaaatcctataaaacggtctcacccctatctccctttgctgactctcttttcagactcagcccgcctgcacccaggtgattaaaaaggtttattgctcacacaaagcctgtttggtgatctcttcacacggatgcaggtgaaatttggtgtcatgactcggatcaggggacctcccttgggagatcaataccctgtcctcctgctctttgctccatgagaaaggtgcacctacaacatcgggtcctcagaccaaccagcccaaggaacatctcaccaattttaaatcatgtaagcggcctctttttactctcttctccaacctctctcactatccctcaacccctttctcctttcaatcttggtgccatccttcaatctctcccttctcttaatttcaattcttttccttttctggtagagacagaggagatgtgttttatccacgaccccaaaactccggtgctggtcatgaactcaggaaaacagtcttcccttggtgtttaatcactgcaaggatggctgcttgattattcacccacgtttcagaggtgtctgatcaccgcggggatgcctgccttgatccttcacccttagcggcaagcactgcttttctgggggcaagcagcccccaccctttctctccgtgtctctaccccttttccacttccctgggaggcaagcacctcccacccttctccactttccttgggggcaagcaccccccaccccttctctccatgtcctctcttttctctgggcttgcctccttcactatgggcaaacttccaccctccattcctccctcttctcccttagcctgtgttctcaaaaacttaaaacctcttcaactcacacctgacctaaaacctaaatgccttattttcttctgcaacaccgcttggccccaatacaaacttgataatggctctaaatggccagaaaactgcattttcagtttctccatcctacaagacctagataatttttgtcaaaaaatgggcaaatggtctgaggtgccttacatccagacatttttcacacttcgttccctccctagtctctgttcccaatgcaattcctcccaaatcatccttgtttccctcccgcctgtcccctcagtcccaacctcaagcatcgctgagtctttccaatcttccttttctacagacccatctgacctctctcctcctccccaggctgctcctcaccaggccaagccaggtcccagttcttcctcagcctctgctcctccaccctataatctttctatcacctcccctccttacacctggtctggcttacggtttagttctgtgactagctctccccaacctgcccaacaatttcctcttagagaggtggctggagctgaaggcatagtcagggtacatgtgcctttttctctatcggacctctctcagatcagtcagcgtttaggatctttctcatcaggccctactaaatatatacatgaattccaatatctaactctgtcctacaatttaacctggagtgacttaaatgtcatcctaacttttatcctcccactagatgaatgggaaagagttttttctctggcccaatctcacactgacaactgtcggctccacaagccagacctccaggaaggcattagagaagttccccaagaggatccccaatggaactatcaggaaaattccccaggtatagctaggcgagattacatgatttcctgcctagttgaagggcttaaaaaggcagcttacaaagctattaattatgacaagcttaaagaaactacccaaggtacagacaaaaacccagcccagtccatggcttgtttggcagcaaccatgagacactttgcagccctagaccctgaaggtcagaaggctgtctcattctaaatatgcattttatcacccagtcagctcctgacattagaaaagaacttcaaaaattagaatccggccctcaaaccccacaataggaattaatcaacctcgccttcaagatgtacagtaatagagaggagacaggcagatggcaacgcatttctgagttacaattacttgcctctgctgtgagacaaaacccagccgcacctccagcacacaagaacttcaaaatgcctaagctgcacatgcctaagccacagcagtcaagcattcctacaggacttcctccatcaggatcttgcttcaagtgccagaaatctggccactgggccaaggaatgcctgcagcctgggattcctcccaagctgtgtcccatctgtgcagggacccactggaaatcagactgcccagctcacccagcagccactcctagagctgctaaagctctaggccaaggctctctgactgactccttcccagatctgctcagcttagcggctgaagactgacgctgcccaatcacctcagaaaccccctggaccaacacggactccgagtttcgggtaattctcacagtggactgaccctgacacccatcagtcccagaagcttacctgggctgtgctgcctcaaggcttcagggacagccctcattacttcagccaagctctttctcatcatttactttctttccacccctccacttctcaccttattcaatatattgatgaccttctactttgtagcccctccattgaatcttcccaacaagacaccctcctgctccttcaacatttattctccaaagggtatcgggtatcccccaccaaagctcaaatttcttctccatccgttacctacctcagcataattcttcataaaaacacacatgctctccctactgatcacgtccaactgatctctcaaaccccaaccctttctacaaaacaactcctttccttcctaggcatggttggatactttcacctttggatacctggttttgccatcctaacaaaaccattatataaactcacaaaaggaaacctagctgaccccatagatcctaaatcttttccccactcctctttccgttccttgaagacagctttagagactgctcccacactagctctccctgactcatcccaatccttttcattacacacagccgcagtgcagggctgtgcagctggaattcttacacaaggaccgggactgtaccctgtagcctttttatccaaacaacttgaccttactgttttaggctggccatcatgtctccgtgcagcggctgccaccgccctaatacttttagaagaccccaaaatcacaaactatgctcaactcactctctacagctctcataacttccaaaatctattttcttcctcacacctgacacatatactttctgctccccagctccttcagctatactcactctttgttgagtctcccacaattaccattgttcctggcccagacttcaatccagcctcccacattattccagataccacacctgacccccatgactgtatctctctgatccacctgactttcaccccatttccccatatttccttctttcctgttcctcaccctgatcacatttggtttattgatggcagctccaccaggcctaatcagcactcaccagcaaaggcaggctatgctatagtatcttccatgtctatcattgaggctaccactctgcctccctccactacctctcagcaagctgaactcattgccttaacttgggtcctcactcttgcaaagggactacacatcaatatttatactgactctaaatacaccttccatatcctgcactaccatgctgttatatgggcagaaagaggtttcctcactatacaagtgtcctccatcattaatgcctctttaataaaaactcttctcaaggctgctttacttccaaagaaaggtggagtcattcactgcaagggccaccaaaaggcatcagatcccattgctctaggcaatgcttatgttaataaggtagctaaagaagtagctagcattccaacttctgtccctcatggccagtttttctccttctcatcggtcactcccacctactcccccactgaaacttccacctatcaatctcttcccacacaaggcaaatatcttagaccaaggaaaatatctccttccagcctcacaggcccattctattctgtcatgatttcataacctcttccatgttggttacaagctgctagcccgtctcttagaacctctcattttctttccatcatggaaatctgtcctcaaggaaatcacttctcagtgttccatccgctagtctactgtccctcaggtattgttcaggccccctcccttccgtacacatcaagcttggggatttgcccctgctcaggactggcaaattgactttactcacatgtcctgagtcaggaaactaaaatacctcttggtctgggtagacactttcactggatgggtagaggcctttcccacagggtctgagaaggccaccgtggtcatttcatcccttctgtcagacataattcctcagtttggccttcccacctctgtacagtctggtaacggaccggcctttactagtcaaattacccaagcagtttctcaggctcttggtattcagtggaaccttcataccccttaccatcctcaatcttcaggaaaagtaaaacagactaatggtcttttaaaaacacatctcaccaagctcagcctccaacttaaaaaggactggacaatacttttaccacttgcccttctcagaattcgggcctgtcttcaggatgctataggttacagcccatttgagcttctgtatggacactcctttttattaggccaccagcccacttgaactgcaccccaaaaacttggatagagcctaaaaactcaccaaccaagcaagcaattacgctaagccccctcggcactctctaattggatgtcctgggtcctcccaattcttagtcctttaatacctgtttttctccttctcttatttggaccttgtgtcttccgtttagtttctcaattcatacaaaactgcattgaggccatcaccaatcattctatatgacaaatgctccttttaacaaccccacaatatcgcctcttaccacaaaatcttccttcagcttaatctctcccactctaggttcccatgctgcccctaatcccgctcgaagcagccctgagaaacatcacccattatctctccataccactgccaaaacttttcactgccccaacactttaccactatttcattttatttttcttattaatataagaagacaggaatgtcaggcctctgggcccaagcctgcacgtatacatccagatggcctgaagtaactgaagaatgacaaaagaagtgaaaatagccagttcctgccttaactgatgacattaccttgtgaaacatcttctcctggctcatcctggctcgaaagctcacccactgagcaccttgtgaccctgacccctgctagccagagaacaaccccctttgactgtaattttccactacctacccaaatcctataaaatggccccacccctatctccctttgctgactctcttttcggactcagcctgcctgcacccaggtgattaaaaagctttattgctcacgcaaagcctgtttggtggtctcttcacatggatgcgcatgaaa

SEQ ID NO: 508 - DNA, 447 bp, Homo sapiens
gtcaggcctctgagcccaagccaagacatcgcatcccctgtgacttgcacatatatgcccagatggcctgaagtaactgaagaatcacaaaagaagtgaaaatgccctgccttaactgatgacattccaccacaaaagaagtgaaaatggccggtccttgccttaagtgatgacattaccttgtgaaagtccttttcctggctcatcctggctctaaaagctcccccactgagcaccttgcgacccccccactcctgcctgccagagaacaaaccctctttgactgtaattttcctttaggtacccaaatcttataaaacggccccacccctatctcccttcgctgactctctttttggactcagcatgcctgcacccaggtgattaaaagctttattgctcacacaaagcctgtttggtggtctcttcacatggacgcgcatgaaa

SEQ ID NO: 509 - DNA, 502 bp, Homo sapiens
gtaggagattggtcactgtggtgggaaaaattgtagaaagatgcaaaccttcttggaaggccgggagattttacaaaagcttcagaaaaggatttggctgaaggcagccagattctctcaccctgtgcctgaacgcttaggttagataacaaggagatgtaaagaaactgatctagataacttagtttacttagtagaacctggcctttaatcatctgagtgcaggactgctggggctgtgtgtgtgtgtggggtggggaaggggggaagcaccatgttaattacccaaaagtgtgttgactcaaggcctttgtcattaaatctgtataaataaatgcctgcagcaccagcttgtcagggccacagctgctacaactctttacaacaccctccttggggtacatgagcagccgagtctcctagcccactctcactggatacctgtgtctgagtgcatccgttcatccatcgcttggtcggggtctgtgggtcagacccagca

SEQ ID NO: 510 - DNA, 1902 bp, Homo sapiens
tctaaacttttagaggccctcaaaatcacaaactatgctcaactcactctctaaagttcacaacttccaaaatctatttgcttcctcatacctgatgcatatactttctgctccccggctccttcagctgtactcactctttgttgagtctcccacaattaccattttccctggcccagacttcaatctggcctcccacattattcctgataccacacctgacccccataactgtatctctctgacccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctctcagaacctctcatttcctttccattgtggaaatctatcctcaaggaaataacttctcagtgttccatctgctattctactactcctcagggattattcaggccccatcccttccctacacatcaagctcgaggatttgcccccacccagaactggcaaattagctttactcaacatgcctgagtcaggaaactaaaatacctcttagtctaaatagacacttttactgaataagtaaaggcctttcctacagggtctgagaagtccaccgcagtcatttcttcccttctgtcagccataattcttcagtttagccttcccacctcaatacggtctgataacagtgagcctttattagtcaaatcagccaagcagtttttcaggctcttagtaatggactaaaggtcttttaaaaacacacctcaccaagctcagccactaacttaaaaaggactggacaatacatttaccacttttgcttctcagaattcaggcctgtcctcagaatgctacaaggtacagcccatttgagctcctgtatagatactcctttttgttaggccccagtctcatttgacaccagaccaacttagactgtgccccaaaaaaacttgtcatccctactatcttttgtctagtcatactcctattcaccgttctcaactactcatacatgccctgctcttgtttacactgccagtttacactgtttctccaagccatcacagctgatatctaccttttatacctgtttttctccttctcttattccatttagtttttcaattcatacaaaaccatatccaggccatcgccaatcattctatacgacaaatgtttcttctaactaccccacaatatcaccccttaccacaagacctcccttcagcttaatctctcccactctaggttcccacaccgcccctaatcccgctcgaagcagccctgagaaacattgcccattctctcttcataccaccccccaaagattttcgcagccccaacacttcaacactattttatttttcttattaatataagaaagcaggaatgtcaggcctctgagcccaagacaagccaagccatcgcatcccctgtgacctgcacgtatacacccagatggcctgaagtaactgaagaatcacaaaagaagtgaatatgccctgccccaccttaactgatgacattccaccacaaaagaagtgtaaatggctggtccttgccttaactgatgacattaccttgtgaaagtccttttcctagctcaccctggctcaaaaacacccccactgagcaccttgctaccccaactcctgcccaccagagaacaaaccccctttgactgtaattttcctttacctacccaaatcctataaaacggccccacccttatctcccttcgctgactcttttctgactcagccccactgcacccaggtgattaaaagctttattgctcacacgaagcctgtttggtcgtctcttcacacggatgtgcatgaaa

The invention claimed is:

1. A method for detecting at least two RNA transcripts, comprising:
obtaining a biological sample that is collected from a human patient suspected of having ovarian cancer; and
detecting, in the biological sample, the presence or absence of at least two RNA transcripts comprising a first RNA transcript expressed by a first nucleic acid sequence having at least 99% identity with SEQ ID NO: 2, and a second RNA transcript expressed by a second nucleic acid sequence having at least 99% identity with SEQ ID NO: 3.

2. The method as claimed in claim 1, further comprising detecting, in the biological sample, the presence or absence of a third RNA transcript expressed by a third nucleic acid sequence having at least 99% identity with SEQ ID NO: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, or 510.

3. The method as claimed in claim 1, further comprising detecting, in the biological sample, the presence or absence of a third RNA transcript expressed by a third nucleic acid sequence having at least 99% identity with SEQ ID NO: 1, 17, or 29, and a fourth RNA transcript expressed by a fourth nucleic acid sequence having at least 99% identity with SEQ ID NO: 1, 17, or 29.

4. The method as claimed in claim 1, further comprising detecting, in the biological sample, a third RNA transcript expressed by a third nucleic acid sequence having at least 99% identity with SEQ ID NO: 6, 9, 10, 11, 20, 23, 24, 25, 26, 30, 34, 59, or 139.

5. The method as claimed in claim 4, wherein the third nucleic acid sequence has at least 99% identity with SEQ ID NO: 6.

6. The method as claimed in claim 1, wherein the at least two RNA transcripts are mRNA transcripts.

7. The method as claimed in claim 1, wherein the at least two RNA transcripts are detected by hybridization, amplification, or sequencing.

8. The method as claimed in claim 6, wherein the mRNA transcripts are detected by bringing the mRNA transcripts into contact with a probe and/or a primer, and detecting the presence or absence of hybridization to the mRNA transcripts.

9. The method as claimed in claim 6, wherein the mRNA transcripts are detected by detecting the presence or absence of cDNAs obtained from the mRNA transcripts.

10. A method for detecting at least two RNA transcripts comprising:
obtaining a biological sample that is collected from a human patient that has been diagnosed with ovarian cancer; and
detecting, in the biological sample, the presence or absence of at least two RNA transcripts comprising a first RNA transcript expressed by a first nucleic acid sequence having at least 99% identity with SEQ ID NO: 2, and a second RNA transcript expressed by a second nucleic acid sequence having at least 99% identity with SEQ ID NO: 3.

11. The method as claimed in claim 10, further comprising detecting, in the biological sample, the presence or absence of a third RNA transcript expressed by a third nucleic acid sequence having at least 99% identity with SEQ ID NO: 1, 4, 5, 7, 8, 12, 13, 14, 15, 16, 17, 18, 19, 21, 22, 27, 28, 29, 31, 32, 33, 35, 36, 37, 38, 39, 40, 41, 42, 43, 44, 45, 46, 47, 48, 49, 50, 51, 52, 53, 54, 55, 56, 57, 58, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, or 510.

12. The method as claimed in claim 10, further comprising detecting, in the biological sample, the presence or absence of a third RNA transcript expressed by a third nucleic acid sequence having at least 99% identity with SEQ ID NO: 1, 17, or 29, and a fourth RNA transcript expressed by a fourth nucleic acid sequence having at least 99% identity with SEQ ID NO: 1, 17, or 29.

13. The method as claimed in claim 9, wherein the presence or absence of the cDNAs is detected by bringing the cDNAs into contact with a probe and/or a primer, and detecting the presence or absence of hybridization to the cDNAs.

14. The method as claimed in claim 1, wherein the first nucleic acid sequence is SEQ ID NO: 2, and the second nucleic acid sequence is SEQ ID NO: 3.

15. The method as claimed in claim 14, wherein
the at least two RNA transcripts are mRNA transcripts, and
the mRNA transcripts are detected by detecting the presence or absence of cDNAs obtained from the mRNA transcripts.

16. The method as claimed in claim 14, further comprising determining an expression level of the at least two RNA transcripts in the biological sample.

17. The method as claimed in claim 1, further comprising determining an expression level of the at least two RNA transcripts in the biological sample.

18. A method for detecting at least two RNA transcripts, comprising:
obtaining a biological sample that is collected from a human patient suspected of having ovarian cancer;
detecting, in the biological sample, the presence or absence of a first RNA transcript expressed by a first nucleic acid sequence having at least 99% identity with SEQ ID NO: 2 by contacting the first RNA transcript or cDNA obtained therefrom with a first probe or primers to respectively hybridize to or amplify a region within the first RNA transcript or cDNA obtained therefrom that is defined by a distinct region within the first nucleic acid sequence; and
detecting, in the biological sample, the presence or absence of a second RNA transcript expressed by a second nucleic acid sequence having at least 99% identity with SEQ ID NO: 3 by contacting the second RNA transcript or cDNA obtained therefrom with a second probe or primers to respectively hybridize to or amplify a region within the second RNA transcript or cDNA obtained therefrom that is defined by a distinct region within the second nucleic acid sequence.

19. The method as claimed in claim 1, wherein no more than 510 specific binding partners are used to detect the at least two RNA transcripts.

* * * * *